US011141476B2

(12) United States Patent
Rauch

(10) Patent No.: US 11,141,476 B2
(45) Date of Patent: Oct. 12, 2021

(54) MERS CORONAVIRUS VACCINE

(71) Applicant: CureVac AG, Tübingen (DE)

(72) Inventor: Susanne Rauch, Tübingen (DE)

(73) Assignee: CureVac AG, Tübingen (DE)

( * ) Notice: Subject to any disclaimer, the term of this patent is extended or adjusted under 35 U.S.C. 154(b) by 0 days.

(21) Appl. No.: 16/471,539

(22) PCT Filed: Dec. 22, 2017

(86) PCT No.: PCT/EP2017/084564
§ 371 (c)(1),
(2) Date: Jun. 19, 2019

(87) PCT Pub. No.: WO2018/115527
PCT Pub. Date: Jun. 28, 2018

(65) Prior Publication Data
US 2019/0351048 A1    Nov. 21, 2019

(30) Foreign Application Priority Data

Dec. 23, 2016   (WO) ................ PCT/EP2016/082669

(51) Int. Cl.
| | | |
|---|---|---|
| *A61K 39/215* | (2006.01) | |
| *C12N 15/86* | (2006.01) | |
| *C07K 14/165* | (2006.01) | |
| *A61K 39/00* | (2006.01) | |

(52) U.S. Cl.
CPC .......... *A61K 39/215* (2013.01); *C07K 14/165* (2013.01); *C12N 15/86* (2013.01); *A61K 2039/53* (2013.01); *C12N 2770/20011* (2013.01)

(58) Field of Classification Search
None
See application file for complete search history.

(56) References Cited

U.S. PATENT DOCUMENTS

| | | |
|---|---|---|
| 2005/0032730 A1 | 2/2005 | von der Mülbe et al. |
| 2005/0059624 A1 | 3/2005 | Hoerr et al. |
| 2005/0250723 A1 | 11/2005 | Hoerr et al. |
| 2006/0188490 A1 | 8/2006 | Hoerr et al. |
| 2008/0025944 A1 | 1/2008 | Hoerr et al. |
| 2008/0267873 A1 | 10/2008 | Hoerr et al. |
| 2009/0324584 A1 | 12/2009 | Hoerr et al. |
| 2010/0048883 A1 | 2/2010 | Ketterer et al. |
| 2010/0189729 A1 | 7/2010 | Hoerr et al. |
| 2010/0203076 A1 | 8/2010 | Fotin-Mleczek et al. |
| 2010/0291156 A1 | 11/2010 | Barner et al. |
| 2010/0305196 A1 | 12/2010 | Probst et al. |
| 2011/0053829 A1 | 3/2011 | Baumhof et al. |
| 2011/0250225 A1 | 10/2011 | Fotin-Mleczek et al. |
| 2012/0021043 A1 | 1/2012 | Kramps et al. |
| 2012/0258046 A1 | 10/2012 | Mutzke |
| 2013/0129754 A1 | 5/2013 | Thess et al. |
| 2013/0142818 A1 | 6/2013 | Baumhof et al. |
| 2013/0259879 A1 | 10/2013 | Baumhof et al. |
| 2013/0280283 A1 | 10/2013 | Lorenz et al. |
| 2013/0295043 A1 | 11/2013 | Kallen et al. |
| 2013/0336998 A1 | 12/2013 | Kallen et al. |
| 2015/0037326 A1 | 2/2015 | Butler-Ransohoff et al. |
| 2015/0050302 A1 | 2/2015 | Thess |
| 2015/0057340 A1 | 2/2015 | Thess et al. |
| 2015/0093413 A1 | 4/2015 | Thess et al. |
| 2015/0118183 A1 | 4/2015 | Baumhof |
| 2015/0118264 A1 | 4/2015 | Baumhof et al. |
| 2015/0165006 A1 | 6/2015 | Thess et al. |
| 2015/0184195 A1 | 7/2015 | Thess et al. |
| 2015/0218554 A1 | 8/2015 | Thess |
| 2015/0306249 A1 | 10/2015 | Baumhof et al. |
| 2015/0320847 A1 | 11/2015 | Thess et al. |
| 2016/0130345 A1 | 5/2016 | Fotin-Mleczek et al. |
| 2016/0166668 A1 | 6/2016 | Kallen et al. |
| 2016/0166678 A1 | 6/2016 | Kallen et al. |
| 2016/0166710 A1 | 6/2016 | Baumhof |
| 2016/0166711 A1 | 6/2016 | Schnee et al. |
| 2016/0168207 A1 | 6/2016 | Kramps et al. |
| 2016/0168227 A1 | 6/2016 | Kallen et al. |
| 2016/0235864 A1 | 8/2016 | Schlake et al. |
| 2016/0304883 A1 | 10/2016 | Grund et al. |
| 2016/0304938 A1 | 10/2016 | Wochner |

(Continued)

FOREIGN PATENT DOCUMENTS

| | | |
|---|---|---|
| WO | WO 2015/164674 | 10/2015 |
| WO | WO 2017/021546 | 2/2017 |

(Continued)

OTHER PUBLICATIONS

Gen Bank Accession AFS88941, E protein [Human betacoronavirus 2c EMC/2012], 2012.*
Genbank Accession JX869059, Human betacoronavirus 2c EMC/2012, complete genome, 2012.*
Genbank Accession AFS88936, S protein [Human betacoronavirus 2c EMC/2012], 2012.*
Du et al., "The spike protein of SARS-CoV—a target for vaccine and therapeutic development", Nat. Rev. Microbiol., 7(3):226-236, 2009.
International Preliminary Report on Patentability issued in corresponding PCT Application No. PCT/EP2017/084564, dated Jun. 25, 2019.

(Continued)

*Primary Examiner* — Benjamin P Blumel
(74) *Attorney, Agent, or Firm* — Parker Highlander PLLC

(57) ABSTRACT

The present invention relates to mRNAs suitable for use as mRNA-based vaccines against infections with MERS coronaviruses. Additionally, the present invention relates to a composition comprising the mRNAs and the use of the mRNAs or the composition for the preparation of a pharmaceutical composition, especially a vaccine, e.g. for use in the prophylaxis or treatment of MERS coronavirus infections. The present invention further describes a method of treatment or prophylaxis of infections with MERS coronavirus using the mRNA sequences.

10 Claims, 4 Drawing Sheets
Specification includes a Sequence Listing.

(56) References Cited

U.S. PATENT DOCUMENTS

| | | |
|---|---|---|
| 2016/0317647 A1* | 11/2016 | Ciaramella ........ A61K 31/7105 |
| 2016/0326575 A1 | 11/2016 | van der Mülbe |
| 2016/0331844 A1 | 11/2016 | Fotin-Mleczek et al. |
| 2017/0014496 A1 | 1/2017 | Fotin-Mleczek et al. |
| 2017/0029847 A1 | 2/2017 | Thess |
| 2017/0114378 A1 | 4/2017 | Wochner et al. |
| 2017/0252430 A1 | 9/2017 | Fotin-Mleczek et al. |
| 2017/0326225 A1 | 11/2017 | Rauch et al. |
| 2018/0044687 A1 | 2/2018 | Thess et al. |
| 2018/0125952 A1 | 5/2018 | Fotin-Mleczek et al. |
| 2018/0126003 A1 | 5/2018 | Hoerr |
| 2018/0142275 A1 | 5/2018 | Roos et al. |
| 2018/0147146 A1 | 5/2018 | Eber et al. |
| 2018/0148727 A1 | 5/2018 | Grund et al. |
| 2018/0201967 A1 | 7/2018 | Eber et al. |
| 2018/0208957 A1 | 7/2018 | Roos et al. |
| 2018/0214537 A1 | 8/2018 | Mutzke et al. |
| 2018/0237786 A1 | 8/2018 | Schlake et al. |
| 2018/0237817 A1 | 8/2018 | Roos et al. |
| 2018/0243219 A1 | 8/2018 | Ketterer et al. |
| 2018/0296663 A1 | 10/2018 | Hipp et al. |
| 2018/0298372 A1 | 10/2018 | Funkner et al. |
| 2018/0312545 A1 | 11/2018 | Baumhof et al. |
| 2018/0371392 A1 | 12/2018 | Mayer et al. |
| 2019/0010485 A1 | 1/2019 | Yazdan Panah et al. |
| 2019/0017100 A1 | 1/2019 | Wochner et al. |
| 2019/0024096 A1 | 1/2019 | Schmid et al. |
| 2019/0040378 A1 | 2/2019 | Fotin-Mleczek et al. |
| 2019/0049414 A1 | 2/2019 | Wochner et al. |
| 2019/0083602 A1 | 3/2019 | Roos et al. |
| 2019/0100784 A1 | 4/2019 | Eber et al. |
| 2019/0125857 A1 | 5/2019 | Rauch et al. |
| 2019/0133950 A1 | 5/2019 | Eber et al. |
| 2019/0160164 A1 | 5/2019 | Rauch et al. |
| 2019/0177714 A1 | 6/2019 | Kunze et al. |
| 2019/0185859 A1 | 6/2019 | Fotin-Mleczek et al. |
| 2019/0194760 A1 | 6/2019 | Koch et al. |
| 2019/0225971 A1 | 7/2019 | Williams |
| 2019/0241633 A1 | 8/2019 | Fotin-Mleczek et al. |
| 2019/0249219 A1 | 8/2019 | Reichert et al. |
| 2019/0336608 A1 | 11/2019 | Baumhof et al. |
| 2019/0336611 A1 | 11/2019 | Baumhof et al. |
| 2019/0343933 A1 | 11/2019 | Horscroft et al. |
| 2019/0343942 A1 | 11/2019 | Fotin-Mleczek et al. |
| 2019/0351044 A1 | 11/2019 | Jasny et al. |
| 2019/0351047 A1 | 11/2019 | Jasny et al. |
| 2019/0351048 A1 | 11/2019 | Rauch |

FOREIGN PATENT DOCUMENTS

| | | |
|---|---|---|
| WO | WO 2018/078053 | 5/2017 |
| WO | WO 2017/137095 | 8/2017 |
| WO | WO 2017/140905 | 8/2017 |
| WO | WO 2017/186928 | 11/2017 |
| WO | WO 2017/191258 | 11/2017 |
| WO | WO 2017/212008 | 12/2017 |
| WO | WO 2017/212009 | 12/2017 |
| WO | WO 2018/096179 | 5/2018 |
| WO | WO 2018/104540 | 6/2018 |
| WO | WO 2018/167320 | 9/2018 |
| WO | WO 2018/172556 | 9/2018 |
| WO | WO 2018/211038 | 11/2018 |

OTHER PUBLICATIONS

International Search Report and Written Opinion issued in corresponding PCT Application No. PCT/EP2017/084564, dated Jul. 17, 2018.

Muthumani et al., "A synthetic consensus anti-spike protein DNA vaccine induces coronavirus in nonhuman protective immunity against Middle East respiratory syndrome primates", *Sci. Transl. Med.*, 7(301):301ra132-301ra132, 2015.

\* cited by examiner

MERS CORONAVIRUS VACCINE

This application is a national phase application under 35 U.S.C. § 371 of International Application No. PCT/EP2017/084564, filed Dec. 22, 2017, which claims benefit of International Application No. PCT/EP2016/082669, filed Dec. 23, 2016, the entire contents of each of which are hereby incorporated by reference.

The present invention relates to mRNAs suitable for use as mRNA-based vaccines against infections with MERS coronaviruses. Additionally, the present invention relates to a composition comprising the mRNAs and the use of the mRNAs or the composition for the preparation of a pharmaceutical composition, especially a vaccine, e.g. for use in the prophylaxis or treatment of MERS coronavirus infections. The present invention further describes a method of treatment or prophylaxis of infections with MERS coronavirus using the mRNA sequences.

In 2012, a new human disease called Middle East respiratory syndrome (MERS), having a high mortality rate, emerged in the Middle East. MERS is caused by a virus that was originally called human coronavirus-Erasmus Medical Center/2012 (HCoV-EMC/2012), but was later renamed as Middle East respiratory syndrome coronavirus (MERS coronavirus or MERS-CoV). Coronaviruses, members of the Coronaviridae family and the Coronaviridae subfamily, are found in mammals and birds. A prominent member is severe acute respiratory syndrome coronavirus (SARS-CoV), which killed almost 10% of the affected individuals in China between 2002 and 2003 and with which MERS-CoV shares some similarities. MERS coronavirus is endemic throughout the Arabian Peninsula, but several cases were reported outside the Middle East. A larger ongoing outbreak is taking place in the Republic of Korea.

Typical symptoms of a MERS coronavirus infection include fever, cough, shortness of breath, pneumonia and gastrointestinal symptoms (e.g. diarrhea). Severe illness can lead to respiratory failure that requires mechanical ventilation and support in an intensive care unit. MERS coronavirus appears to cause more severe disease in older people, people with weakened immune systems and those with chronic diseases, such as cancer, chronic lung disease and diabetes.

At present no vaccine or specific treatment is available for MERS. Patients diagnosed with a MERS coronavirus infection merely receive supportive treatment based on the individual's symptoms and clinical condition. Approximately 36% of patients diagnosed with MERS have died. Hence, there is an urgent need for a safe and effective treatment or prophylaxis of MERS and, in particular, of a MERS coronavirus vaccine. Further needs regarding LASV vaccine properties, characteristics or performances comprise e.g.

- Induction of a strong humoral immune response
- Induction of B-cell memory
- Fast onset of immune protection
- Longevity of the induced immune responses
- Induction of broad cellular T-cell responses
- Induction of a (local and transient) pro-inflammatory environment
- No induction of systemic cytokine or chemokine response
- Well tolerability, no side-effects, non toxic
- Advantageous stability characteristics
- Formulation(s) compatible with many different antigens: larger antigen cocktails feasible based on the same (production) technology
- No vector immunity, i.e. technology can be used to vaccinate the same subject multiple times against multiple (different) antigens
- Speed, adaptability, simplicity and scalability of production Therefore, it is the object of the underlying invention to provide a vaccine for MERS coronavirus infections. Furthermore, it is an object of the present invention to provide a system, which allows for expression of an antigen derived from a MERS coronavirus in a mammalian cell. Furthermore, it is the object of the present invention to provide an effective MERS coronavirus vaccine, which can be stored and transported without cold chain and which enables rapid and scalable vaccine production.

These objects are solved by the subject matter of the attached claims. Particularly, the objects underlying the present invention are solved according to a first aspect by an inventive mRNA sequence comprising a coding region, encoding at least one antigenic peptide or protein comprising or consisting of a MERS coronavirus protein or a fragment or variant thereof.

Definitions

For the sake of clarity and readability, the following scientific background information and definitions are provided. Any technical features disclosed thereby can be part of each and every embodiment of the invention. Additional definitions and explanations can be provided in the context of this disclosure.

Vaccine for a MERS Coronavirus Infection or MERS Vaccine:

A vaccine directed against a MERS coronavirus is referred to herein as a vaccine for MERS coronavirus infection or MERS vaccine.

Immune System:

The immune system may protect organisms from infection. If a pathogen breaks through a physical barrier of an organism and enters this organism, the innate immune system provides an immediate, but non-specific response. If pathogens evade this innate response, vertebrates possess a second layer of protection, the adaptive immune system. Here, the immune system adapts its response during an infection to improve its recognition of the pathogen. This improved response is then retained after the pathogen has been eliminated, in the form of an immunological memory, and allows the adaptive immune system to mount faster and stronger attacks each time this pathogen is encountered. According to this, the immune system comprises the innate and the adaptive immune system. Each of these two parts contains so called humoral and cellular components.

Immune Response:

An immune response may typically either be a specific reaction of the adaptive immune system to a particular antigen (so called specific or adaptive immune response) or an unspecific reaction of the innate immune system (so called unspecific or innate immune response). The invention relates to the core to specific reactions (adaptive immune responses) of the adaptive immune system. Particularly, it relates to adaptive immune responses to infections by viruses like e.g. MERS coronaviruses. However, this specific response can be supported by an additional unspecific reaction (innate immune response). Therefore, the invention also relates to a compound for simultaneous stimulation of the innate and the adaptive immune system to evoke an efficient adaptive immune response.

Adaptive Immune System:

The adaptive immune system is composed of highly specialized, systemic cells and processes that eliminate or prevent pathogenic growth. The adaptive immune response provides the vertebrate immune system with the ability to recognize and remember specific pathogens (to generate immunity), and to mount stronger attacks each time the pathogen is encountered. The system is highly adaptable because of somatic hypermutation (a process of increased frequency of somatic mutations), and V(D)J recombination (an irreversible genetic recombination of antigen receptor gene segments). This mechanism allows a small number of genes to generate a vast number of different antigen receptors, which are then uniquely expressed on each individual lymphocyte. Because the gene rearrangement leads to an irreversible change in the DNA of each cell, all of the progeny (offspring) of that cell will then inherit genes encoding the same receptor specificity, including the Memory B cells and Memory T cells that are the keys to long-lived specific immunity. Immune network theory is a theory of how the adaptive immune system works, that is based on interactions between the variable regions of the receptors of T cells, B cells and of molecules made by T cells and B cells that have variable regions.

Adaptive Immune Response:

The adaptive immune response is typically understood to be antigen-specific. Antigen specificity allows for the generation of responses that are tailored to specific antigens, pathogens or pathogen-infected cells. The ability to mount these tailored responses is maintained in the body by "memory cells". Should a pathogen infect the body more than once, these specific memory cells are used to quickly eliminate it. In this context, the first step of an adaptive immune response is the activation of naïve antigen-specific T cells or different immune cells able to induce an antigen-specific immune response by antigen-presenting cells. This occurs in the lymphoid tissues and organs through which naïve T cells are constantly passing. Cell types that can serve as antigen-presenting cells are inter alia dendritic cells, macrophages, and B cells. Each of these cells has a distinct function in eliciting immune responses. Dendritic cells take up antigens by phagocytosis and macropinocytosis and are stimulated by contact with e.g. a foreign antigen to migrate to the local lymphoid tissue, where they differentiate into mature dendritic cells. Macrophages ingest particulate antigens such as bacteria and are induced by infectious agents or other appropriate stimuli to express MHC molecules. The unique ability of B cells to bind and internalize soluble protein antigens via their receptors may also be important to induce T cells. Presenting the antigen on MHC molecules leads to activation of T cells which induces their proliferation and differentiation into armed effector T cells. The most important function of effector T cells is the killing of infected cells by CD8+ cytotoxic T cells and the activation of macrophages by Th1 cells which together make up cell-mediated immunity, and the activation of B cells by both Th2 and Th1 cells to produce different classes of antibody, thus driving the humoral immune response. T cells recognize an antigen by their T cell receptors which do not recognize and bind antigen directly, but instead recognize short peptide fragments e.g. of pathogen-derived protein antigens, which are bound to MHC molecules on the surfaces of other cells.

Cellular Immunity/Cellular Immune Response:

Cellular immunity relates typically to the activation of macrophages, natural killer cells (NK), antigen-specific cytotoxic T-lymphocytes, and the release of various cytokines in response to an antigen. In a more general way, cellular immunity is not related to antibodies but to the activation of cells of the immune system. A cellular immune response is characterized e.g. by activating antigen-specific cytotoxic T-lymphocytes that are able to induce apoptosis in body cells displaying epitopes of an antigen on their surface, such as virus-infected cells, cells with intracellular bacteria, and cancer cells displaying tumor antigens; activating macrophages and natural killer cells, enabling them to destroy pathogens; and stimulating cells to secrete a variety of cytokines that influence the function of other cells involved in adaptive immune responses and innate immune responses.

Humoral Immunity/Humoral Immune Response:

Humoral immunity refers typically to antibody production and the accessory processes that may accompany it. A humoral immune response may be typically characterized, e.g., by Th2 activation and cytokine production, germinal center formation and isotype switching, affinity maturation and memory cell generation. Humoral immunity also typically may refer to the effector functions of antibodies, which include pathogen and toxin neutralization, classical complement activation, and opsonin promotion of phagocytosis and pathogen elimination.

Innate Immune System:

The innate immune system, also known as non-specific immune system, comprises the cells and mechanisms that defend the host from infection by other organisms in a non-specific manner. This means that the cells of the innate system recognize and respond to pathogens in a generic way, but unlike the adaptive immune system, it does not confer long-lasting or protective immunity to the host. The innate immune system may be e.g. activated by ligands of pathogen-associated molecular patterns (PAMP) receptors, e.g. Toll-like receptors (TLRs) or other auxiliary substances such as lipopolysaccharides, TNF-alpha, CD40 ligand, or cytokines, monokines, lymphokines, interleukins or chemokines, IL-1, IL-2, IL-3, IL-4, IL-5, IL-6, IL-7, IL-8, IL-9, IL-10, IL-12, IL-13, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, IFN-alpha, IFN-beta, IFN-gamma, GM-CSF, G-CSF, M-CSF, LT-beta, TNF-alpha, growth factors, and hGH, a ligand of human Toll-like receptor TLR1, TLR2, TLR3, TLR4, TLR5, TLR6, TLR7, TLR8, TLR9, TLR10, a ligand of murine Toll-like receptor TLR1, TLR2, TLR3, TLR4, TLR5, TLR6, TLR7, TLR8, TLR9, TLR10, TLR11, TLR12 or TLR13, a ligand of a NOD-like receptor, a ligand of a RIG-I like receptor, an immunostimulatory nucleic acid, an immunostimulatory RNA (isRNA), a CpG-DNA, an antibacterial agent, or an anti-viral agent. Typically a response of the innate immune system includes recruiting immune cells to sites of infection, through the production of chemical factors, including specialized chemical mediators, called cytokines; activation of the complement cascade; identification and removal of foreign substances present in organs, tissues, the blood and lymph, by specialized white blood cells; activation of the adaptive immune system through a process known as antigen presentation; and/or acting as a physical and chemical barrier to infectious agents.

Adjuvant/Adjuvant Component:

An adjuvant or an adjuvant component in the broadest sense is typically a (e.g. pharmacological or immunological) agent or composition that may modify, e.g. enhance, the efficacy of other agents, such as a drug or vaccine. Conventionally the term refers in the context of the invention to a compound or composition that serves as a carrier or auxiliary substance for immunogens and/or other pharmaceutically active compounds. It is to be interpreted in a broad sense and refers to a broad spectrum of substances that are able to increase the immunogenicity of antigens incorporated into or co-administered with an adjuvant in question. In the context of the present invention an adjuvant will preferably enhance the specific immunogenic effect of the active agents of the present invention. Typically, "adjuvant" or "adjuvant component" has the same meaning and can be used mutually. Adjuvants may be divided, e.g., into immunopotentiators, antigenic delivery systems or even combinations thereof.

The term "adjuvant" is typically understood not to comprise agents which confer immunity by themselves. An adjuvant assists the immune system unspecifically to enhance the antigen-specific immune response by e.g. promoting presentation of an antigen to the immune system or induction of an unspecific innate immune response. Furthermore, an adjuvant may preferably e.g. modulate the antigen-specific immune response by e.g. shifting the dominating Th2-based antigen specific response to a more Th1-based antigen specific response or vice versa. Accordingly, an adjuvant may favourably modulate cytokine expression/secretion, antigen presentation, type of immune response etc.

Immunostimulatory RNA:

An immunostimulatory RNA (isRNA) in the context of the invention may typically be an RNA that is able to induce an innate immune response itself. It usually does not have an open reading frame and thus does not provide a peptide-antigen or immunogen but elicits an innate immune response e.g. by binding to a specific kind of Toll-like-receptor (TLR) or other suitable receptors. However, of course also mRNAs having an open reading frame and coding for a peptide/protein (e.g. an antigenic function) may induce an innate immune response.

Antigen:

In the context of the present invention "antigen" refers typically to a substance which may be recognized by the immune system, preferably by the adaptive immune system, and is capable of triggering an antigen-specific immune response, e.g. by formation of antibodies and/or antigen-specific T cells as part of an adaptive immune response. Typically, an antigen may be or may comprise a peptide or protein which may be presented by the MHC to T-cells. In the sense of the present invention an antigen may be the product of translation of a provided nucleic acid molecule, preferably an mRNA as defined herein. In this context, also fragments, variants and derivatives of peptides and proteins comprising at least one epitope are understood as antigen.

Epitope (Also Called "Antigen Determinant"):

T cell epitopes or parts of the proteins in the context of the present invention may comprise fragments preferably having a length of about 6 to about 20 or even more amino acids, e.g. fragments as processed and presented by MHC class I molecules, preferably having a length of about 8 to about 10 amino acids, e.g. 8, 9, or 10, (or even 11, or 12 amino acids), or fragments as processed and presented by MHC class II molecules, preferably having a length of about 13 or more amino acids, e.g. 13, 14, 15, 16, 17, 18, 19, 20 or even more amino acids, wherein these fragments may be selected from any part of the amino acid sequence. These fragments are typically recognized by T cells in form of a complex consisting of the peptide fragment and an MHC molecule.

B cell epitopes are typically fragments located on the outer surface of (native) protein or peptide antigens as defined herein, preferably having 5 to 15 amino acids, more preferably having 5 to 12 amino acids, even more preferably having 6 to 9 amino acids, which may be recognized by antibodies, i.e. in their native form.

Such epitopes of proteins or peptides may furthermore be selected from any of the herein mentioned variants of such proteins or peptides. In this context antigenic determinants can be conformational or discontinuous epitopes which are composed of segments of the proteins or peptides as defined herein that are discontinuous in the amino acid sequence of the proteins or peptides as defined herein but are brought together in the three-dimensional structure or continuous or linear epitopes which are composed of a single polypeptide chain.

Vaccine:

A vaccine is typically understood to be a prophylactic or therapeutic material providing at least one antigen or antigenic function. The antigen or antigenic function may stimulate the body's adaptive immune system to provide an adaptive immune response.

Antigen-Providing mRNA:

An antigen-providing mRNA in the context of the invention may typically be an mRNA, having at least one open reading frame that can be translated by a cell or an organism provided with that mRNA. The product of this translation is a peptide or protein that may act as an antigen, preferably as an immunogen. The product may also be a fusion protein composed of more than one immunogen, e.g. a fusion protein that consist of two or more epitopes, peptides or proteins derived from the same or different virus-proteins, wherein the epitopes, peptides or proteins may be linked by linker sequences.

Artificial mRNA (Sequence):

An artificial mRNA (sequence) may typically be understood to be an mRNA molecule, that does not occur naturally. In other words, an artificial mRNA molecule may be understood as a non-natural mRNA molecule. Such mRNA molecule may be non-natural due to its individual sequence (which does not occur naturally) and/or due to other modifications, e.g. structural modifications of nucleotides which do not occur naturally. Typically, artificial mRNA molecules may be designed and/or generated by genetic engineering methods to correspond to a desired artificial sequence of nucleotides (heterologous sequence). In this context an artificial sequence is usually a sequence that may not occur naturally, i.e. it differs from the wild type sequence by at least one nucleotide. The term "wild type" may be understood as a sequence occurring in nature. Further, the term "artificial nucleic acid molecule" is not restricted to mean "one single molecule" but is, typically, understood to comprise an ensemble of identical molecules. Accordingly, it may relate to a plurality of identical molecules contained in an aliquot.

Bi-/Multicistronic mRNA:

mRNA, that typically may have two (bicistronic) or more (multicistronic) open reading frames (ORF) (coding regions or coding sequences). An open reading frame in this context is a sequence of several nucleotide triplets (codons) that can be translated into a peptide or protein. Translation of such an mRNA yields two (bicistronic) or more (multicistronic) distinct translation products (provided the ORFs are not identical). For expression in eukaryotes such mRNAs may for example comprise an internal ribosomal entry site (IRES) sequence.

5'-Cap Structure

A 5'-cap is typically a modified nucleotide (cap analogue), particularly a guanine nucleotide, added to the 5'-end of an mRNA molecule. Preferably, the 5'-cap is added using a 5'-5'-triphosphate linkage (also named m7GpppN). Further examples of 5'-cap structures include glyceryl, inverted deoxy abasic residue (moiety), 4',5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5 dihydroxypentyl nucleotide, 3'-3'-inverted nucleotide moiety, 3'-3'-inverted abasic moiety, 3'-2'-inverted nucleotide moiety, 3'-2'-inverted abasic moiety, 1,4-butanediol phosphate, 3'-phosphoramidate, hexylphosphate, aminohexyl phosphate, 3'-phosphate, 3' phosphorothioate, phosphorodithioate, or bridging or non-bridging methylphosphonate moiety. These modified 5'-cap structures may be used in the context of the present invention to modify the mRNA sequence of the inventive composition. Further modified 5'-cap structures which may be used in the context of the present invention are CAP1 (additional methylation of the ribose of the adjacent nucleotide of m7GpppN), CAP2 (additional methylation of the ribose of the 2nd nucleotide downstream of the m7GpppN), cap3 (additional methylation of the ribose of the 3rd nucleotide downstream of the m7GpppN), cap4 (additional methylation of the ribose of the 4th nucleotide downstream of the m7GpppN), ARCA (anti-reverse CAP analogue), modified ARCA (e.g. phosphothioate modified ARCA), inosine, N1-methyl-guanosine, 2'-fluoro-guanosine, 7-deaza-guanosine, 8-oxo-guanosine, 2-amino-guanosine, LNA-guanosine, and 2-azido-guanosine.

In the context of the present invention, a 5'-cap structure may also be formed in chemical RNA synthesis or RNA in vitro transcription (co-transcriptional capping) using cap analogues, or a cap structure may be formed in vitro using capping enzymes (e.g., commercially available capping kits).

Cap Analogue:

A cap analogue refers to a non-polymerizable di-nucleotide that has cap functionality in that it facilitates translation or localization, and/or prevents degradation of the RNA molecule when incorporated at the 5'-end of the RNA molecule. Non-polymerizable means that the cap analogue will be incorporated only at the 5' terminus because it does not have a 5' triphosphate and therefore cannot be extended in the 3' direction by a template-dependent RNA polymerase.

Cap analogues include, but are not limited to, a chemical structure selected from the group consisting of m7GpppG, m7GpppA, m7GpppC; unmethylated cap analogues (e.g., GpppG); demethylated cap analogue (e.g., m2,7GpppG), trimethylated cap analogue (e.g., m2,2,7GpppG), demethylated symmetrical cap analogues (e.g., m7Gpppm7G), or anti reverse cap analogues (e.g., ARCA; m7,2'OmeGpppG, m7,2'dGpppG, m7,3'OmeGpppG, m7,3'dGpppG and their tetraphosphate derivatives) (Stepinski et al., 2001. RNA 7(10):1486-95).

Further cap analogues have been described previously (U.S. Pat. No. 7,074,596, WO2008/016,473, WO2008/157, 688, WO2009/149,253, WO2011/015,347, and WO2013/059,475). The synthesis of N7-(4-chlorophenoxyethyl) substituted dinucleotide cap analogues has been described recently (Kore et al. (2013) Bioorg. Med. Chem. 21(15): 4570-4).

Fragments of Proteins:

"Fragments" of proteins or peptides in the context of the present invention may, typically, comprise a sequence of a protein or peptide as defined herein, which is, with regard to its amino acid sequence (or its encoded nucleic acid molecule), N—terminally and/or C-terminally truncated compared to the amino acid sequence of the original (native) protein (or its encoded nucleic acid molecule). Such truncation may thus occur either on the amino acid level or correspondingly on the nucleic acid level. A sequence identity with respect to such a fragment as defined herein may therefore preferably refer to the entire protein or peptide as defined herein or to the entire (coding) nucleic acid molecule of such a protein or peptide.

In this context a fragment of a protein may typically comprise an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with an amino acid sequence of the respective naturally occurring full-length protein.

Fragments of proteins or peptides in the context of the present invention may furthermore comprise a sequence of a protein or peptide as defined herein, which has a length of for example at least 5 amino acids, preferably a length of at least 6 amino acids, preferably at least 7 amino acids, more preferably at least 8 amino acids, even more preferably at least 9 amino acids; even more preferably at least 10 amino acids; even more preferably at least 11 amino acids; even more preferably at least 12 amino acids; even more preferably at least 13 amino acids; even more preferably at least 14 amino acids; even more preferably at least 15 amino acids; even more preferably at least 16 amino acids; even more preferably at least 17 amino acids; even more preferably at least 18 amino acids; even more preferably at least 19 amino acids; even more preferably at least 20 amino acids; even more preferably at least 25 amino acids; even more preferably at least 30 amino acids; even more preferably at least 35 amino acids; even more preferably at least 50 amino acids; or most preferably at least 100 amino acids. For example such fragment may have a length of about 6 to about 20 or even more amino acids, e.g. fragments as processed and presented by MHC class I molecules, preferably having a length of about 8 to about 10 amino acids, e.g. 8, 9, or 10, (or even 6, 7, 11, or 12 amino acids), or fragments as processed and presented by MHC class II molecules, preferably having a length of about 13 or more amino acids, e.g. 13, 14, 15, 16, 17, 18, 19, 20 or even more amino acids, wherein these fragments may be selected from any part of the amino acid sequence. These fragments are typically recognized by T-cells in form of a complex consisting of the peptide fragment and an MHC molecule, i.e. the fragments are typically not recognized in their native form. Fragments of proteins or peptides may comprise at least one epitope of those proteins or peptides. Furthermore also domains of a protein, like the extracellular domain, the intracellular domain or the transmembrane domain and shortened or truncated versions of a protein may be understood to comprise a fragment of a protein.

Variants of Proteins:

"Variants" of proteins or peptides as defined in the context of the present invention may be generated, having an amino acid sequence which differs from the original sequence in one or more mutation(s), such as one or more substituted, inserted and/or deleted amino acid(s). Preferably, these fragments and/or variants have the same biological function or specific activity compared to the full-length native protein, e.g. its specific antigenic property. "Variants" of proteins or peptides as defined in the context of the present invention may comprise conservative amino acid substitution(s) compared to their native, i.e. non-mutated physiological, sequence. Those amino acid sequences as well as their encoding nucleotide sequences in particular fall under the term "variants" as defined herein. Substitutions in which amino acids, which originate from the same class, are exchanged for one another are called conservative substitutions. In particular, these are amino acids having aliphatic side chains, positively or negatively charged side chains, aromatic groups in the side chains or amino acids, the side chains of which can enter into hydrogen bridges, e.g. side chains which have a hydroxyl function. This means that e.g. an amino acid having a polar side chain is replaced by another amino acid having a likewise polar side chain, or, for example, an amino acid characterized by a hydrophobic side chain is substituted by another amino acid having a likewise hydrophobic side chain (e.g. serine (threonine) by threonine (serine) or leucine (isoleucine) by isoleucine (leucine)). Insertions and substitutions are possible, in particular, at those sequence positions which cause no modification to the three-dimensional structure or do not affect the binding region. Modifications to a three-dimensional structure by insertion(s) or deletion(s) can easily be determined e.g. using CD spectra (circular dichroism spectra) (Urry, 1985, Absorption, Circular Dichroism and ORD of Polypeptides, in: Modern Physical Methods in Biochemistry, Neuberger et al. (ed.), Elsevier, Amsterdam).

A "variant" of a protein or peptide may have at least 70%, 75%, 80%, 85%, 90%, 95%, 98% or 99% amino acid identity over a stretch of 10, 20, 30, 50, 75 or 100 amino acids of such protein or peptide.

Furthermore, variants of proteins or peptides as defined herein, which may be encoded by a nucleic acid molecule, may also comprise those sequences, wherein nucleotides of the encoding nucleic acid sequence are exchanged according to the degeneration of the genetic code, without leading to an alteration of the respective amino acid sequence of the protein or peptide, i.e. the amino acid sequence or at least part thereof may not differ from the original sequence in one or more mutation(s) within the above meaning.

Identity of a Sequence:

In order to determine the percentage to which two sequences are identical, e.g. nucleic acid sequences or amino acid sequences as defined herein, preferably the amino acid sequences encoded by a nucleic acid sequence of the polymeric carrier as defined herein or the amino acid sequences themselves, the sequences can be aligned in order to be subsequently compared to one another. Therefore, e.g. a position of a first sequence may be compared with the corresponding position of the second sequence. If a position in the first sequence is occupied by the same component (residue) as is the case at a position in the second sequence, the two sequences are identical at this position. If this is not the case, the sequences differ at this position. If insertions occur in the second sequence in comparison to the first sequence, gaps can be inserted into the first sequence to allow a further alignment. If deletions occur in the second sequence in comparison to the first sequence, gaps can be inserted into the second sequence to allow a further alignment. The percentage to which two sequences are identical is then a function of the number of identical positions divided by the total number of positions including those positions which are only occupied in one sequence. The percentage to which two sequences are identical can be determined using a mathematical algorithm. A preferred, but not limiting, example of a mathematical algorithm which can be used is the algorithm of Karlin et al. (1993), PNAS USA, 90:5873-5877 or Altschul et al. (1997), Nucleic Acids Res., 25:3389-3402. Such an algorithm is integrated in the BLAST program. Sequences which are identical to the sequences of the present invention to a certain extent can be identified by this program.

Monocistronic mRNA:

A monocistronic mRNA may typically be an mRNA, that comprises only one open reading frame (coding sequence or coding region). An open reading frame in this context is a sequence of several nucleotide triplets (codons) that can be translated into a peptide or protein.

Nucleic Acid:

The term "nucleic acid" means any DNA- or RNA-molecule and is used synonymous with polynucleotide. Wherever herein reference is made to a nucleic acid or nucleic acid sequence encoding a particular protein and/or peptide, said nucleic acid or nucleic acid sequence, respectively, preferably also comprises regulatory sequences allowing in a suitable host, e.g. a human being, its expression, i.e. transcription and/or translation of the nucleic acid sequence encoding the particular protein or peptide.

Peptide:

A peptide is a polymer of amino acid monomers. Usually the monomers are linked by peptide bonds. The term "peptide" does not limit the length of the polymer chain of amino acids. In some embodiments of the present invention a peptide may for example contain less than 50 monomer units. Longer peptides are also called polypeptides, typically having 50 to 600 monomeric units, more specifically 50 to 300 monomeric units.

Pharmaceutically Effective Amount:

A pharmaceutically effective amount in the context of the invention is typically understood to be an amount that is sufficient to induce an immune response.

Protein:

A protein typically consists of one or more peptides and/or polypeptides folded into 3-dimensional form, facilitating a biological function.

Poly (C) Sequence:

A poly-(C)—sequence is typically a long sequence of cytosine nucleotides, typically about 10 to about 200 cytosine nucleotides, preferably about 10 to about 100 cytosine nucleotides, more preferably about 10 to about 70 cytosine nucleotides or even more preferably about 20 to about 50 or even about 20 to about 30 cytosine nucleotides. A poly(C) sequence may preferably be located 3' of the coding region comprised by a nucleic acid.

Poly-A-Tail/Sequence:

A poly-A-tail also called "3'-poly(A) tail or poly(A) sequence" is typically a long sequence of adenosine nucleotides of up to about 400 adenosine nucleotides, e.g. from about 25 to about 400, preferably from about 50 to about 400, more preferably from about 50 to about 300, even more preferably from about 50 to about 250, most preferably from about 60 to about 250 adenosine nucleotides, added to the 3' end of a RNA. Moreover, poly(A) sequences, or poly(A) tails may be generated in vitro by enzymatic polyadenylation of the RNA, e.g. using Poly(A)polymerases derived from E. coli or yeast.

Polyadenylation:

Polyadenylation is typically understood to be the addition of a poly(A) sequence to a nucleic acid molecule, such as an RNA molecule, e.g. to a premature mRNA. Polyadenylation may be induced by a so called polyadenylation signal. This signal is preferably located within a stretch of nucleotides at the 3'-end of a nucleic acid molecule, such as an RNA molecule, to be polyadenylated. A polyadenylation signal typically comprises a hexamer consisting of adenine and uracil/thymine nucleotides, preferably the hexamer sequence AAUAAA. Other sequences, preferably hexamer sequences, are also conceivable. Polyadenylation typically occurs during processing of a pre-mRNA (also called pre-mature-mRNA). Typically, RNA maturation (from pre-mRNA to mature mRNA) comprises the step of polyadenylation.

Stabilized Nucleic Acid, Preferably mRNA:

A stabilized nucleic acid, preferably mRNA typically, exhibits a modification increasing resistance to in vivo degradation (e.g. degradation by an exo- or endo-nuclease) and/or ex vivo degradation (e.g. by the manufacturing process prior to vaccine administration, e.g. in the course of the preparation of the vaccine solution to be administered). Stabilization of RNA can, e.g., be achieved by providing a 5'-CAP—Structure, a Poly-A-Tail, or any other UTR-modification. It can also be achieved by chemical modification or modification of the G/C-content of the nucleic acid. Various other methods are known in the art and conceivable in the context of the invention.

Carrier/Polymeric Carrier:

A carrier in the context of the invention may typically be a compound that facilitates transport and/or complexation of another compound. Said carrier may form a complex with said other compound. A polymeric carrier is a carrier that is formed of a polymer.

Cationic Component/Compound:

The term "cationic component/compound" typically refers to a charged molecule, which is positively charged (cation) at a pH value of typically about 1 to 9, preferably of a pH value of or below 9 (e.g. 5 to 9), of or below 8 (e.g. 5 to 8), of or below 7 (e.g. 5 to 7), most preferably at physiological pH values, e.g. about 7.3 to 7.4. Accordingly, a cationic peptide, protein, polysaccharide, lipid or polymer according to the present invention is positively charged under physiological conditions, particularly under physiological salt conditions of the cell in vivo. A cationic peptide or protein preferably contains a larger number of cationic amino acids, e.g. a larger number of Arg, His, Lys or Orn than other amino acid residues (in particular more cationic amino acids than anionic amino acid residues like Asp or Glu) or contains blocks predominantly formed by cationic amino acid residues. The definition "cationic" may also refer to "polycationic" components/compounds.

Vehicle:

An agent, e.g. a carrier, that may typically be used within a pharmaceutical composition or vaccine for facilitating administering of the components of the pharmaceutical composition or vaccine to an individual.

3'-untranslated Region 3'-UTR

A 3'-UTR is typically the part of an mRNA which is located between the protein coding region (i.e. the open reading frame) and the poly(A) sequence of the mRNA. A 3'-UTR of the mRNA is not translated into an amino acid sequence. The 3'-UTR sequence is generally encoded by the gene which is transcribed into the respective mRNA during the gene expression process. The genomic sequence is first transcribed into pre-mature mRNA, which comprises optional introns. The pre-mature mRNA is then further processed into mature mRNA in a maturation process. This maturation process comprises the steps of 5'-capping, splicing the pre-mature mRNA to excise optional introns and modifications of the 3'-end, such as polyadenylation of the 3'-end of the pre-mature mRNA and optional endo- or exonuclease cleavages etc. In the context of the present invention, a 3'-UTR corresponds to the sequence of a mature mRNA which is located 3' to the stop codon of the protein coding region, preferably immediately 3' to the stop codon of the protein coding region, and which extends to the 5'-side of the poly(A) sequence, preferably to the nucleotide immediately 5' to the poly(A) sequence. The term "corresponds to" means that the 3'-UTR sequence may be an RNA sequence, such as in the mRNA sequence used for defining the 3'-UTR sequence, or a DNA sequence which corresponds to such RNA sequence. In the context of the present invention, the term "a 3'-UTR of a gene", such as "a 3'-UTR of an albumin gene", is the sequence which corresponds to the 3'-UTR of the mature mRNA derived from this gene, i.e. the mRNA obtained by transcription of the gene and maturation of the pre-mature mRNA. The term "3'-UTR of a gene" encompasses the DNA sequence and the RNA sequence of the 3'-UTR.

5'-untranslated region (5'-UTR): A 5'-UTR is typically understood to be a particular section of messenger RNA (mRNA). It is located 5' of the open reading frame of the mRNA. Typically, the 5'-UTR starts with the transcriptional start site and ends one nucleotide before the start codon of the open reading frame. The 5'-UTR may comprise elements for controlling gene expression, also called regulatory elements. Such regulatory elements may be, for example, ribosomal binding sites or a 5'-Terminal Oligopyrimidine Tract. The 5'-UTR may be posttranscriptionally modified, for example by addition of a 5'-cap. In the context of the present invention, a 5'-UTR corresponds to the sequence of a mature mRNA which is located between the 5'-cap and the start codon. Preferably, the 5'-UTR corresponds to the sequence which extends from a nucleotide located 3 to the 5'-cap, preferably from the nucleotide located immediately 3' to the 5'-cap, to a nucleotide located 5' to the start codon of the protein coding region, preferably to the nucleotide located immediately 5 to the start codon of the protein coding region. The nucleotide located immediately 3' to the 5'-cap of a mature mRNA typically corresponds to the transcriptional start site. The term "corresponds to" means that the 5'-UTR sequence may be an RNA sequence, such as in the mRNA sequence used for defining the 5'-UTR sequence, or a DNA sequence which corresponds to such RNA sequence. In the context of the present invention, the term "a 5'-UTR of a gene", such as "a 5'-UTR of a TOP gene", is the sequence which corresponds to the 5'-UTR of the mature mRNA derived from this gene, i.e. the mRNA obtained by transcription of the gene and maturation of the pre-mature mRNA. The term "5'-UTR of a gene" encompasses the DNA sequence and the RNA sequence of the 5'-UTR.

5' Terminal Oligopyrimidine Tract TOP

The 5' terminal oligopyrimidine tract (TOP) is typically a stretch of pyrimidine nucleotides located at the 5'-terminal region of a nucleic acid molecule, such as the 5'-terminal region of certain mRNA molecules or the 5'-terminal region of a functional entity, e.g. the transcribed region, of certain genes. The sequence starts with a cytidine, which usually corresponds to the transcriptional start site, and is followed by a stretch of usually about 3 to 30 pyrimidine nucleotides. For example, the TOP may comprise 3, 4, 5, 6, 7, 8, 9, 10, 11, 12, 13, 14, 15, 16, 17, 18, 19, 20, 21, 22, 23, 24, 25, 26, 27, 28, 29, 30 or even more nucleotides. The pyrimidine stretch and thus the 5' TOP ends one nucleotide 5' to the first purine nucleotide located downstream of the TOP. Messenger RNA that contains a 5' terminal oligopyrimidine tract is often referred to as TOP mRNA. Accordingly, genes that provide such messenger RNAs are referred to as TOP genes. TOP sequences have, for example, been found in genes and mRNAs encoding peptide elongation factors and ribosomal proteins.

TOP motif: In the context of the present invention, a TOP motif is a nucleic acid sequence which corresponds to a 5'TOP as defined above. Thus, a TOP motif in the context of the present invention is preferably a stretch of pyrimidine nucleotides having a length of 3-30 nucleotides. Preferably, the TOP-motif consists of at least 3 pyrimidine nucleotides, preferably at least 4 pyrimidine nucleotides, preferably at least 5 pyrimidine nucleotides, more preferably at least 6 nucleotides, more preferably at least 7 nucleotides, most preferably at least 8 pyrimidine nucleotides, wherein the stretch of pyrimidine nucleotides preferably starts at its 5'-end with a cytosine nucleotide. In TOP genes and TOP mRNAs, the TOP-motif preferably starts at its 5'-end with the transcriptional start site and ends one nucleotide 5' to the first purin residue in said gene or mRNA. A TOP motif in the sense of the present invention is preferably located at the 5'-end of a sequence which represents a 5'-UTR or at the 5'-end of a sequence which codes for a 5'-UTR. Thus, preferably, a stretch of 3 or more pyrimidine nucleotides is called "TOP motif" in the sense of the present invention if this stretch is located at the 5'-end of a respective sequence, such as the inventive mRNA, the 5'-UTR element of the inventive mRNA, or the nucleic acid sequence which is derived from the 5'-UTR of a TOP gene as described herein. In other words, a stretch of 3 or more pyrimidine nucleotides which is not located at the 5'-end of a 5'-UTR or a 5'-UTR element but anywhere within a 5'-UTR or a 5'-UTR element is preferably not referred to as "TOP motif".

TOP Gene:

TOP genes are typically characterised by the presence of a 5'-terminal oligopyrimidine tract. Furthermore, most TOP genes are characterized by a growth-associated translational regulation. However, also TOP genes with a tissue specific translational regulation are known. As defined above, the 5'-UTR of a TOP gene corresponds to the sequence of a 5'-UTR of a mature mRNA derived from a TOP gene, which preferably extends from the nucleotide located 3' to the 5'-cap to the nucleotide located 5' to the start codon. A 5'-UTR of a TOP gene typically does not comprise any start codons, preferably no upstream AUGs (uAUGs) or upstream open reading frames (uORFs). Therein, upstream AUGs and upstream open reading frames are typically understood to be AUGs and open reading frames that occur 5' of the start codon (AUG) of the open reading frame that should be translated. The 5'-UTRs of TOP genes are generally rather short. The lengths of 5'-UTRs of TOP genes may vary between 20 nucleotides up to 500 nucleotides, and are typically less than about 200 nucleotides, preferably less than about 150 nucleotides, more preferably less than about 100 nucleotides. Exemplary 5'-UTRs of TOP genes in the sense of the present invention are the nucleic acid sequences extending from the nucleotide at position 5 to the nucleotide located immediately 5 to the start codon (e.g. the ATG) in the sequences according to SEQ ID NOs: 1-1363, SEQ ID NO: 1395, SEQ ID NO: 1421 and SEQ ID NO: 1422 of the international patent application WO2013/143,700 or homologs or variants thereof, whose disclosure is incorporated herewith by reference. In this context a particularly preferred fragment of a 5'-UTR of a TOP gene is a 5'-UTR of a TOP gene lacking the 5'TOP motif. The term "5'-UTR of a TOP gene" preferably refers to the 5'-UTR of a naturally occurring TOP gene.

Fragment of a Nucleic Acid Sequence, Particularly an mRNA:

A fragment of a nucleic acid sequence consists of a continuous stretch of nucleotides corresponding to a continuous stretch of nucleotides in the full-length nucleic acid sequence which is the basis for the nucleic acid sequence of the fragment, which represents at least 20%, preferably at least 30%, more preferably at least 40%, more preferably at least 50%, even more preferably at least 60%, even more preferably at least 70%, even more preferably at least 80%, and most preferably at least 90% of the full-length nucleic acid sequence. A 'fragment of a nucleic acid sequence' e.g. a fragment of the inventive mRNA is preferably a nucleic acid sequence encoding a fragment of a protein or of a variant thereof as described herein. More preferably, the expression 'fragment of a nucleic acid sequence' refers to a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a respective full-length nucleic acid sequence. Such a fragment, in the sense of the present invention, is preferably a functional fragment of the full-length nucleic acid sequence.

Variant of a Nucleic Acid Sequence, Particularly an mRNA:

A variant of a nucleic acid sequence refers to a variant of nucleic acid sequences which forms the basis of a nucleic acid sequence. For example, a variant nucleic acid sequence may exhibit one or more nucleotide deletions, insertions, additions and/or substitutions compared to the nucleic acid sequence from which the variant is derived. Preferably, a variant of a nucleic acid sequence is at least 40%, preferably at least 50%, more preferably at least 60%, more preferably at least 70%, even more preferably at least 80%, even more preferably at least 90%, most preferably at least 95% identical to the nucleic acid sequence the variant is derived from. Preferably, the variant is a functional variant. A "variant" of a nucleic acid sequence may have at least 70%, 75%, 80%, 85%, 90%, 95%, 98% or 99% nucleotide identity over a stretch of 10, 20, 30, 50, 75 or 100 nucleotide of such nucleic acid sequence. A variant of a nucleic acid sequence as used herein preferably encodes a protein or a fragment thereof as defined herein. The expression 'variant of a nucleic acid sequence' in the context of a nucleic acid sequence encoding a protein or a fragment thereof, typically refers to a nucleic acid sequence, which differs by at least one nucleic acid residue from the respective naturally occurring nucleic acid sequence encoding a protein or a fragment thereof. More preferably, the expression 'variant of a nucleic acid sequence' refers to a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence, from which it is derived.

Jet Injection:

The term "jet injection", as used herein, refers to a needle-free injection method, wherein a fluid containing at least one inventive mRNA sequence and, optionally, further suitable excipients is forced through an orifice, thus generating an ultra-fine liquid stream of high pressure that is capable of penetrating mammalian skin and, depending on the injection settings, subcutaneous tissue or muscle tissue. In principle, the liquid stream forms a hole in the skin, through which the liquid stream is pushed into the target tissue. Preferably, jet injection is used for intradermal, subcutaneous or intramuscular injection of the mRNA sequence according to the invention. In a preferred embodiment, jet injection is used for intramuscular injection of the mRNA sequence according to the invention. In a further preferred embodiment, jet injection is used for intradermal injection of the mRNA sequence according to the invention.

RNA In Vitro Transcription:

The terms "RNA in vitro transcription" or "in vitro transcription" relate to a process wherein RNA is synthesized in a cell-free system (in vitro). DNA, particularly plasmid DNA, is used as template for the generation of RNA transcripts. RNA may be obtained by DNA-dependent in vitro transcription of an appropriate DNA template, which according to the present invention is preferably a linearized plasmid DNA template. The promoter for controlling in vitro transcription can be any promoter for any DNA-dependent RNA polymerase. Particular examples of DNA-dependent RNA polymerases are the T7, T3, and SP6 RNA polymerases. A DNA template for in vitro RNA transcription may be obtained by cloning of a nucleic acid, in particular cDNA corresponding to the respective RNA to be in vitro transcribed, and introducing it into an appropriate vector for in vitro transcription, for example into plasmid DNA. In a preferred embodiment of the present invention the DNA template is linearized with a suitable restriction enzyme, before it is transcribed in vitro. The cDNA may be obtained by reverse transcription of mRNA or chemical synthesis. Moreover, the DNA template for in vitro RNA synthesis may also be obtained by gene synthesis.

Methods for in vitro transcription are known in the art (see, e.g., Geall et al. (2013) Semin. Immunol. 25(2): 152-159; Brunelle et al. (2013) Methods Enzymol. 530:101-14). Reagents used in said method typically include:

1) a linearized DNA template with a promoter sequence that has a high binding affinity for its respective RNA polymerase such as bacteriophage-encoded RNA polymerases;
2) ribonucleoside triphosphates (NTPs) for the four bases (adenine, cytosine, guanine and uracil);
3) optionally a cap analogue as defined above (e.g. m7G(5') ppp(5')G (m7G));
4) a DNA-dependent RNA polymerase capable of binding to the promoter sequence within the linearized DNA template (e.g. T7, T3 or SP6 RNA polymerase);
5) optionally a ribonuclease (RNase) inhibitor to inactivate any contaminating RNase;
6) optionally a pyrophosphatase to degrade pyrophosphate, which may inhibit transcription;
7) MgCl2, which supplies Mg2+ ions as a co-factor for the polymerase;
8) a buffer to maintain a suitable pH value, which can also contain antioxidants (e.g. DTT), and/or polyamines such as spermidine at optimal concentrations.

Full-Length Protein:

The term "full-length protein" as used herein typically refers to a protein that substantially comprises the entire amino acid sequence of the naturally occurring protein. Nevertheless, substitutions of amino acids e.g. due to mutation in the protein are also encompassed in the term full-length protein.

DETAILED DESCRIPTION

The present invention is based on the inventors surprising finding that an mRNA comprising at least one coding region encoding at least one antigenic peptide or protein derived from a Middle East respiratory syndrome coronavirus (MERS-coronavirus/MERS-CoV), or a fragment or variant of such a protein, induces efficiently antigen-specific immune responses against MERS-coronavirus.

Furthermore, the inventors surprisingly found that mRNA-based vaccines comprising mRNA encoding at least one antigen (particularly an antigenic peptide or protein as described herein) comprising or consisting of a MERS coronavirus protein, preferably a spike protein (S), a spike S1 fragment (S1), an envelope protein (E), a membrane protein (M) or a nucleocapsid protein (N), derived from a MERS-coronavirus, or a fragment or variant of any such protein, are extremely effective in inducing an antigen-specific immune response against MERS coronavirus.

Additionally, the mRNA sequence according to the invention enables rapid and rational vaccine design with flexibility, speed and scalability of production probably exceeding those of current production technologies.

The present invention thus provides an mRNA comprising at least one coding region encoding a polypeptide (such as the antigen mentioned above) comprising or consisting of a peptide or protein derived from MERS coronavirus, or a fragment or variant thereof as described herein.

As used herein, the terms "Middle East respiratory syndrome coronavirus", "MERS coronavirus" or "MERS-CoV" relate to positive-sense, single-stranded RNA viruses of the genus β-coronavirus (lineage C), which typically cause a condition referred to as "Middle East respiratory syndrome (MERS)" or also "camel flu". The term is thus not limited to a particular strain or isolate or to viruses of a particular origin, but may comprise any coronavirus causing or associated with MERS. For example, a MERS coronavirus as referred to herein may originate from the Middle East, e.g. from the Saudi Arabian peninsula, or from East Asia, e.g. China or Korea. Exemplary MERS coronaviruses comprise but are not limited to HCoV-EMC/2012, ChinaGD01 or a related virus.

In the context of the present invention, the term "antigen" typically refers to a polypeptide comprising or consisting of a MERS coronavirus protein, or a fragment or variant thereof as defined herein. An "antigen" as intended herein, may further be the 'antigenic peptide or protein' as described herein.

The expression "antigenic peptide or protein" as used herein typically also refers to a (poly)peptide or protein derived from a protein, preferably a MERS coronavirus protein, which is capable of eliciting an (adaptive) immune response. Therefore an antigenic peptide or protein preferably comprises or provides at least one epitope of the protein it is derived from. The expression comprises (poly)peptides or proteins, without being limited with regard to their length, composition or structure. The term "epitope" or "antigenic determinant" typically refers to the part of an antigen which is recognized by adaptive immune system. An "antigen" is a substance, which is capable of being recognized (typically via its epitope(s)) by the immune system, preferably by the adaptive immune system, and which is capable of eliciting an antigen-specific immune response, e.g. by formation of antibodies and/or antigen-specific T cells as part of an adaptive immune response. In the context of the present invention, "antigens" are preferably peptides or proteins ("antigenic peptides or proteins"). Typically, an antigen comprise or consist a peptide or protein, which may be presented to (antigen-specific) T-cells on MHC surface molecules by the MHC complex. In the sense of the present invention an antigenic peptide or protein is typically the product of translation of a provided nucleic acid molecule, preferably an mRNA as defined herein. As used herein, the term "epitope" in particular refers to a part or fragment of an antigen presented on a MHC surface molecule. Such a fragment comprising or consisting of a (functional epitope) may typically comprise from about 5 to about 20 amino acids. Epitopes can be distinguished in T cell epitopes and B cell epitopes. T cell epitopes or parts of the proteins in the context of the present invention may comprise fragments preferably having a length of about 6 to about 20 or even more amino acids, e.g. fragments as processed and presented by MHC class I molecules, preferably having a length of about 8 to about 10 amino acids, e.g. 8, 9, or 10, (or even 11, or 12 amino acids), or fragments as processed and presented by MHC class II molecules, preferably having a length of about 13 or more amino acids, e.g. 13, 14, 15, 16, 17, 18, 19, 20 or even more amino acids, wherein these fragments may be selected from any part of the amino acid sequence. These fragments are typically recognized by T cells in form of a complex consisting of the peptide fragment and an MHC surface molecule, i.e. the fragments are typically not recognized in their native form. B cell epitopes are typically fragments located on the outer surface of (native) protein or peptide antigens as defined herein, preferably having 5 to 15 amino acids, more preferably having 5 to 12 amino acids, even more preferably having 6 to 9 amino acids, which may be recognized by antibodies, i.e. in their native form. The term "epitope" includes "conformational" (or "discontinuous") epitopes, which are composed of discontinuous sequences of the amino acids of the antigen but are brought together in the three-dimensional structure, and "linear" epitopes, which are formed by a continuous sequence of amino acids from the antigen.

In a preferred embodiment, the inventive mRNA comprises a coding region, encoding at least one antigenic peptide or protein derived from a MERS coronavirus, preferably at least one antigenic peptide or protein comprising or consisting of a spike protein (S), a spike S1 fragment (S1), an envelope protein (E), a membrane protein (M) or a nucleocapsid protein (N) of a MERS-coronavirus, preferably as defined herein. In one embodiment, the encoded at least one antigenic peptide or protein comprises or consists of a full-length spike protein (S), a full-length spike S1 fragment (S1), a full-length nucleocapsid protein (N), a full-length membrane protein (M) or a full-length envelope protein (E) of a MERS coronavirus, preferably as defined herein. Alternatively, the at least one antigenic peptide or protein may comprise or consist of a fragment or variant of any one of these proteins, preferably a fragment or variant as defined herein. In a further embodiment, the at least one antigenic peptide or protein may comprise or consist of a synthetically engineered MERS coronavirus peptide or protein, or a fragment or variant thereof.

The term "full-length protein" as used herein typically refers to a protein that substantially comprises the entire amino acid sequence of the naturally occurring protein, preferably spike protein (5), a spike S1 fragment (S1), nucleocapsid protein (N), membrane protein (M) or envelope protein (E) of a MERS coronavirus. As used herein, the term "full-length protein" preferably relates to the full-length sequence of protein indicated in Table 1-4 and Table 7. More preferably, the term "full-length protein" preferably refers to an amino acid sequence as defined by any one of the SEQ ID NO: 's listed in column 2 in any one of Tables 1-4 (SEQ ID NOs: 1-152) and in Table 7 (SEQ ID NOs: 1448-1548) or to an amino acid provided in the database under the respective database accession number identified in column 1 of any one of Tables 1-4 and Table 7.

Additional information regarding each of the sequences provided in Table 1, 2, 3, 4 and 7 may also be derived from the sequence listing, in particular from the details provided therein under identifier <223>.

In Tables 1-4, each row corresponds to a spike protein (S) (Table 1), a spike S1 fragment (S1) (Table 7) an envelope protein (E) (Table 2), a membrane protein (M) (Table 3) or a nucleocapsid protein (N) (Table 4) of a MERS coronavirus as identified by the database accession number of the corresponding protein (column 1).

Column 2 in Tables 1-4 indicates the SEQ ID NO: corresponding to the respective amino acid sequence as provided herein. The SEQ ID NO: corresponding to the nucleic acid sequence of the wild type mRNA encoding the protein is indicated column 3. Column 4 provides the SEQ ID NO: 's corresponding to modified/optimized nucleic acid sequences of the mRNAs as described herein that encode the protein preferably having the amino acid sequence as defined by the SEQ ID NO: indicated in the column 2 or by the database entry indicated in column 1.

In a preferred embodiment of the invention, the mRNA thus comprises at least one coding region encoding at least one antigenic peptide or protein comprising or consisting of an amino acid sequence according to SEQ ID NO: 1 to 152 or 1448 to 1548, or a fragment or variant of any one of these amino acid sequences.

In this context, a fragment of a protein or a variant thereof encoded by the at least one coding region of the mRNA according to the invention may typically comprise an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with an amino acid sequence of the respective naturally occurring full-length protein or a variant thereof, preferably according to SEQ ID NOs: 1-152 or 1448 to 1548 or preferably as disclosed in column 1 or 2 of Tables 1-4 and Table 7.

It is further preferred that the mRNA according to the invention comprises a coding region comprising or consisting of an RNA sequence according to SEQ ID NO: 153-304 or 1549-1649, or a fragment or variant of any one of these RNA sequences. Preferably, the at least one coding region comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 153-304 or 1549-1649.

TABLE 1

| | | MERS coronavirus spike (S) protein: | | |
|---|---|---|---|---|
| Row | column 1<br>NCBI Accession No. | column 2<br>A | column 3<br>B | column 4<br>C |
| 1 | AFS88936 | 1 | 153 | 305, 457, 609, 761, 913, 1065, 1217 |
| 2 | AFY13307 | 2 | 154 | 306, 458, 610, 762, 914, 1066, 1218 |
| 3 | AGH58717 | 3 | 155 | 307, 459, 611, 763, 915, 1067, 1219 |
| 4 | AGN52936 | 4 | 156 | 308, 460, 612, 764, 916, 1068, 1220 |
| 5 | AGN70951 | 5 | 157 | 309, 461, 613, 765, 917, 1069, 1221 |
| 6 | AGV08408 | 6 | 158 | 310, 462, 614, 766, 918, 1070, 1222 |
| 7 | AGV08455 | 7 | 159 | 311, 463, 615, 767, 919, 1071, 1223 |
| 8 | AGV08467 | 8 | 160 | 312, 464, 616, 768, 920, 1072, 1224 |
| 9 | AGV08492 | 9 | 161 | 313, 465, 617, 769, 921, 1073, 1225 |
| 10 | AGV08584 | 10 | 162 | 314, 466, 618, 770, 922, 1074, 1226 |
| 11 | AHB33326 | 11 | 163 | 315, 467, 619, 771, 923, 1075, 1227 |
| 12 | AHC74088 | 12 | 164 | 316, 468, 620, 772, 924, 1076, 1228 |
| 13 | AHI48528 | 13 | 165 | 317, 469, 621, 773, 925, 1077, 1229 |
| 14 | AHI48550 | 14 | 166 | 318, 470, 622, 774, 926, 1078, 1230 |
| 15 | AHI48583 | 15 | 167 | 319, 471, 623, 775, 927, 1079, 1231 |
| 16 | AHI48605 | 16 | 168 | 320 or 2365, 472, 624, 776, 928, 1080, 1232 |
| 17 | AHY21469 | 17 | 169 | 321, 473, 625, 777, 929, 1081, 1233 |
| 18 | AHZ64057 | 18 | 170 | 322, 474, 626, 778, 930, 1082, 1234 |
| 19 | AID50418 | 19 | 171 | 323, 475, 627, 779, 931, 1083, 1235 |
| 20 | AID55068 | 20 | 172 | 324, 476, 628, 780, 932, 1084, 1236 |
| 21 | AID55073 | 21 | 173 | 325, 477, 629, 781, 933, 1085, 1237 |
| 22 | AIY60528 | 22 | 174 | 326, 478, 630, 782, 934, 1086, 1238 |
| 23 | AIY60558 | 23 | 175 | 327, 479, 631, 783, 935, 1087, 1239 |
| 24 | AIZ74450 | 24 | 176 | 328, 480, 632, 784, 936, 1088, 1240 |
| 25 | AJD81440 | 25 | 177 | 329, 481, 633, 785, 937, 1089, 1241 |
| 26 | AKI29284 | 26 | 178 | 330, 482, 634, 786, 938, 1090, 1242 |
| 27 | AKL59401 | 27 | 179 | 331, 483, 635, 787, 939, 1091, 1243 |
| 28 | AKM76229 | 28 | 180 | 332, 484, 636, 788, 940, 1092, 1244 |
| 29 | AKM76239 | 29 | 181 | 333, 485, 637, 789, 941, 1093, 1245 |
| 30 | AKN11072 | 30 | 182 | 334, 486, 638, 790, 942, 1094, 1246 |
| 31 | AKN11074 | 31 | 183 | 335, 487, 639, 791, 943, 1095, 1247 |
| 32 | AKN24803 | 32 | 184 | 336, 488, 640, 792, 944, 1096, 1248 |
| 33 | AKN24812 | 33 | 185 | 337, 489, 641, 793, 945, 1097, 1249 |
| 34 | AKN24830 | 34 | 186 | 338, 490, 642, 794, 946, 1098, 1250 |
| 35 | ALB08257 | 35 | 187 | 339, 491, 643, 795, 947, 1099, 1251 |
| 36 | ALB08311 | 36 | 188 | 340, 492, 644, 796, 948, 1100, 1252 |
| 37 | ALB08322 | 37 | 189 | 341, 493, 645, 797, 949, 1101, 1253 |
| 38 | ALD51904 | 38 | 190 | 342, 494, 646, 798, 950, 1102, 1254 |
| 39 | ALJ54446 | 39 | 191 | 343, 495, 647, 799, 951, 1103, 1255 |
| 40 | ALJ54448 | 40 | 192 | 344, 496, 648, 800, 952, 1104, 1256 |
| 41 | ALJ54450 | 41 | 193 | 345, 497, 649, 801, 953, 1105, 1257 |
| 42 | ALJ54453 | 42 | 194 | 346, 498, 650, 802, 954, 1106, 1258 |
| 43 | ALJ54455 | 43 | 195 | 347, 499, 651, 803, 955, 1107, 1259 |
| 44 | ALJ54456 | 44 | 196 | 348, 500, 652, 804, 956, 1108, 1260 |
| 45 | ALJ54461 | 45 | 197 | 349, 501, 653, 805, 957, 1109, 1261 |
| 46 | ALJ54468 | 46 | 198 | 350, 502, 654, 806, 958, 1110, 1262 |
| 47 | ALJ54471 | 47 | 199 | 351, 503, 655, 807, 959, 1111, 1263 |
| 48 | ALJ54472 | 48 | 200 | 352, 504, 656, 808, 960, 1112, 1264 |
| 49 | ALJ54474 | 49 | 201 | 353, 505, 657, 809, 961, 1113, 1265 |
| 50 | ALJ54483 | 50 | 202 | 354, 506, 658, 810, 962, 1114, 1266 |
| 51 | ALJ54486 | 51 | 203 | 355, 507, 659, 811, 963, 1115, 1267 |
| 52 | ALJ54488 | 52 | 204 | 356, 508, 660, 812, 964, 1116, 1268 |
| 53 | ALJ54490 | 53 | 205 | 357, 509, 661, 813, 965, 1117, 1269 |
| 54 | ALJ54495 | 54 | 206 | 358, 510, 662, 814, 966, 1118, 1270 |
| 55 | ALJ54496 | 55 | 207 | 359, 511, 663, 815, 967, 1119, 1271 |
| 56 | ALJ54500 | 56 | 208 | 360, 512, 664, 816, 968, 1120, 1272 |
| 57 | ALJ54501 | 57 | 209 | 361, 513, 665, 817, 969, 1121, 1273 |
| 58 | ALJ54502 | 58 | 210 | 362, 514, 666, 818, 970, 1122, 1274 |
| 59 | ALJ54512 | 59 | 211 | 363, 515, 667, 819, 971, 1123, 1275 |
| 60 | ALJ54517 | 60 | 212 | 364, 516, 668, 820, 972, 1124, 1276 |
| 61 | ALJ54518 | 61 | 213 | 365, 517, 669, 821, 973, 1125, 1277 |
| 62 | ALW82691 | 62 | 214 | 366, 518, 670, 822, 974, 1126, 1278 |
| 63 | ALW82742 | 63 | 215 | 367, 519, 671, 823, 975, 1127, 1279 |
| 64 | ALW82753 | 64 | 216 | 368, 520, 672, 824, 976, 1128, 1280 |
| 65 | ALX27228 | 65 | 217 | 369, 521, 673, 825, 977, 1129, 1281 |
| 66 | ALX27232 | 66 | 218 | 370, 522, 674, 826, 978, 1130, 1282 |
| 67 | AMQ48993 | 67 | 219 | 371, 523, 675, 827, 979, 1131, 1283 |
| 68 | AMW90844 | 68 | 220 | 372, 524, 676, 828, 980, 1132, 1284 |
| 69 | AMW90852 | 69 | 221 | 373, 525, 677, 829, 981, 1133, 1285 |
| 70 | AMW90853 | 70 | 222 | 374, 526, 678, 830, 982, 1134, 1286 |
| 71 | ANC28656 | 71 | 223 | 375, 527, 679, 831, 983, 1135, 1287 |
| 72 | ANC28678 | 72 | 224 | 376, 528, 680, 832, 984, 1136, 1288 |
| 73 | AHL18090 | 73 | 225 | 377, 529, 681, 833, 985, 1137, 1289 |
| 74 | AHX00731 | 74 | 226 | 378, 530, 682, 834, 986, 1138, 1290 |
| 75 | AHX71946 | 75 | 227 | 379, 531, 683, 835, 987, 1139, 1291 |

TABLE 1-continued

MERS coronavirus spike (S) protein:

| Row | column 1<br>NCBI Accession No. | column 2<br>A | column 3<br>B | column 4<br>C |
|---|---|---|---|---|
| 76 | AHY22545 | 76 | 228 | 380, 532, 684, 836, 988, 1140, 1292 |
| 77 | AHY22555 | 77 | 229 | 381, 533, 685, 837, 989, 1141, 1293 |
| 78 | AHY22565 | 78 | 230 | 382, 534, 686, 838, 990, 1142, 1294 |
| 79 | AJG44069 | 79 | 231 | 383, 535, 687, 839, 991, 1143, 1295 |
| 80 | AJG44080 | 80 | 232 | 384, 536, 688, 840, 992, 1144, 1296 |
| 81 | AJG44102 | 81 | 233 | 385, 537, 689, 841, 993, 1145, 1297 |
| 82 | AJG44124 | 82 | 234 | 386, 538, 690, 842, 994, 1146, 1298 |
| 83 | ALL26396 | 83 | 235 | 387, 539, 691, 843, 995, 1147, 1299 |
| 84 | ALS20350 | 84 | 236 | 388, 540, 692, 844, 996, 1148, 1300 |
| 85 | ALT66880 | 85 | 237 | 389, 541, 693, 845, 997, 1149, 1301 |
| 86 | ALA49341 | 86 | 238 | 390, 542, 694, 846, 998, 1150, 1302 |
| 87 | ALA49352 | 87 | 239 | 391, 543, 695, 847, 999, 1151, 1303 |
| 88 | ALA49363 | 88 | 240 | 392, 544, 696, 848, 1000, 1152, 1304 |
| 89 | ALA49374 | 89 | 241 | 393, 545, 697, 849, 1001, 1153, 1305 |
| 90 | ALA49396 | 90 | 242 | 394, 546, 698, 850, 1002, 1154, 1306 |
| 91 | ALA49451 | 91 | 243 | 395, 547, 699, 851, 1003, 1155, 1307 |
| 92 | ALA49473 | 92 | 244 | 396, 548, 700, 852, 1004, 1156, 1308 |
| 93 | ALA49583 | 93 | 245 | 397, 549, 701, 853, 1005, 1157, 1309 |
| 94 | ALA49649 | 94 | 246 | 398, 550, 702, 854, 1006, 1158, 1310 |
| 95 | ALA49660 | 95 | 247 | 399, 551, 703, 855, 1007, 1159, 1311 |
| 96 | ALA49671 | 96 | 248 | 400, 552, 704, 856, 1008, 1160, 1312 |
| 97 | ALA49682 | 97 | 249 | 401, 553, 705, 857, 1009, 1161, 1313 |
| 98 | ALA49803 | 98 | 250 | 402, 554, 706, 858, 1010, 1162, 1314 |
| 99 | ALA49836 | 99 | 251 | 403, 555, 707, 859, 1011, 1163, 1315 |
| 100 | ALA49957 | 100 | 252 | 404, 556, 708, 860, 1012, 1164, 1316 |
| 101 | ALA50067 | 101 | 253 | 405, 557, 709, 861, 1013, 1165, 1317 |

In a preferred embodiment, the mRNA according to the invention comprises at least one coding region encoding at least one antigenic peptide or protein comprising or consisting of a spike protein (S) of a MERS coronavirus, or a fragment or variant thereof, which comprises or consists of an amino acid sequence selected from any one of the amino acid sequences according to SEQ ID NO: 1 to 101, or a fragment or variant of any one of these amino acid sequences. More preferably, the at least one encoded antigenic peptide or protein comprises or consists of an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the amino acid sequences according to SEQ ID NO: 1 to 101.

In this context, it is preferred that the mRNA according to the invention comprises at least one coding region comprising or consisting of an RNA sequence according to SEQ ID NO: 153 to 253, or a fragment or variant thereof. Preferably, the at least one coding region comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 153 to 253.

TABLE 7

| MERS coronavirus spike protein S1 (S1): | | | | |
|---|---|---|---|---|
| Row | column 1 NCBI Accession No. | column 2 A | column 3 B | column 4 C |
| 1 | AFS88936 | 1448 | 1549 | 1650, 1751, 1852, 1953, 2054, 2155, 2256 |
| 2 | AFY13307 | 1449 | 1550 | 1651, 1752, 1853, 1954, 2055, 2156, 2257 |
| 3 | AGH58717 | 1450 | 1551 | 1652, 1753, 1854, 1955, 2056, 2157, 2258 |
| 4 | AGN52936 | 1451 | 1552 | 1653, 1754, 1855, 1956, 2057, 2158, 2259 |
| 5 | AGN70951 | 1452 | 1553 | 1654, 1755, 1856, 1957, 2058, 2159, 2260 |
| 6 | AGV08408 | 1453 | 1554 | 1655, 1756, 1857, 1958, 2059, 2160, 2261 |
| 7 | AGV08455 | 1454 | 1555 | 1656, 1757, 1858, 1959, 2060, 2161, 2262 |
| 8 | AGV08467 | 1455 | 1556 | 1657, 1758, 1859, 1960, 2061, 2162, 2263 |
| 9 | AGV08492 | 1456 | 1557 | 1658, 1759, 1860, 1961, 2062, 2163, 2264 |
| 10 | AGV08584 | 1457 | 1558 | 1659, 1760, 1861, 1962, 2063, 2164, 2265 |
| 11 | AHB33326 | 1458 | 1559 | 1660, 1761, 1862, 1963, 2064, 2165, 2266 |
| 12 | AHC74088 | 1459 | 1560 | 1661, 1762, 1863, 1964, 2065, 2166, 2267 |
| 13 | AHI48528 | 1460 | 1561 | 1662, 1763, 1864, 1965, 2066, 2167, 2268 |
| 14 | AHI48550 | 1461 | 1562 | 1663, 1764, 1865, 1966, 2067, 2168, 2269 |
| 15 | AHI48583 | 1462 | 1563 | 1664, 1765, 1866, 1967, 2068, 2169, 2270 |
| 16 | AHI48605 | 1463 | 1564 | 1665 or 2366, 1766, 1867, 1968, 2069, 2170, 2271 |
| 17 | AHY21469 | 1464 | 1565 | 1666, 1767, 1868, 1969, 2070, 2171, 2272 |
| 18 | AHZ64057 | 1465 | 1566 | 1667, 1768, 1869, 1970, 2071, 2172, 2273 |

TABLE 7-continued MERS coronavirus spike protein S1 (S1):

| Row | column 1<br>NCBI Accession No. | column 2<br>A | column 3<br>B | column 4<br>C |
|---|---|---|---|---|
| 19 | AID50418 | 1466 | 1567 | 1668, 1769, 1870, 1971, 2072, 2173, 2274 |
| 20 | AID55068 | 1467 | 1568 | 1669, 1770, 1871, 1972, 2073, 2174, 2275 |
| 21 | AID55073 | 1468 | 1569 | 1670, 1771, 1872, 1973, 2074, 2175, 2276 |
| 22 | AIY60528 | 1469 | 1570 | 1671, 1772, 1873, 1974, 2075, 2176, 2277 |
| 23 | AIY60558 | 1470 | 1571 | 1672, 1773, 1874, 1975, 2076, 2177, 2278 |
| 24 | AIZ74450 | 1471 | 1572 | 1673, 1774, 1875, 1976, 2077, 2178, 2279 |
| 25 | AJD81440 | 1472 | 1573 | 1674, 1775, 1876, 1977, 2078, 2179, 2280 |
| 26 | AKI29284 | 1473 | 1574 | 1675, 1776, 1877, 1978, 2079, 2180, 2281 |
| 27 | AKL59401 | 1474 | 1575 | 1676, 1777, 1878, 1979, 2080, 2181, 2282 |
| 28 | AKM76229 | 1475 | 1576 | 1677, 1778, 1879, 1980, 2081, 2182, 2283 |
| 29 | AKM76239 | 1476 | 1577 | 1678, 1779, 1880, 1981, 2082, 2183, 2284 |
| 30 | AKN11072 | 1477 | 1578 | 1679, 1780, 1881, 1982, 2083, 2184, 2285 |
| 31 | AKN11074 | 1478 | 1579 | 1680, 1781, 1882, 1983, 2084, 2185, 2286 |
| 32 | AKN24803 | 1479 | 1580 | 1681, 1782, 1883, 1984, 2085, 2186, 2287 |
| 33 | AKN24812 | 1480 | 1581 | 1682, 1783, 1884, 1985, 2086, 2187, 2288 |
| 34 | AKN24830 | 1481 | 1582 | 1683, 1784, 1885, 1986, 2087, 2188, 2289 |
| 35 | ALB08257 | 1482 | 1583 | 1684, 1785, 1886, 1987, 2088, 2189, 2290 |
| 36 | ALB08311 | 1483 | 1584 | 1685, 1786, 1887, 1988, 2089, 2190, 2291 |
| 37 | ALB08322 | 1484 | 1585 | 1686, 1787, 1888, 1989, 2090, 2191, 2292 |
| 38 | ALD51904 | 1485 | 1586 | 1687, 1788, 1889, 1990, 2091, 2192, 2293 |
| 39 | ALJ54446 | 1486 | 1587 | 1688, 1789, 1890, 1991, 2092, 2193, 2294 |
| 40 | ALJ54448 | 1487 | 1588 | 1689, 1790, 1891, 1992, 2093, 2194, 2295 |
| 41 | ALJ54450 | 1488 | 1589 | 1690, 1791, 1892, 1993, 2094, 2195, 2296 |
| 42 | ALJ54453 | 1489 | 1590 | 1691, 1792, 1893, 1994, 2095, 2196, 2297 |
| 43 | ALJ54455 | 1490 | 1591 | 1692, 1793, 1894, 1995, 2096, 2197, 2298 |
| 44 | ALJ54456 | 1491 | 1592 | 1693, 1794, 1895, 1996, 2097, 2198, 2299 |
| 45 | ALJ54461 | 1492 | 1593 | 1694, 1795, 1896, 1997, 2098, 2199, 2300 |
| 46 | ALJ54468 | 1493 | 1594 | 1695, 1796, 1897, 1998, 2099, 2200, 2301 |
| 47 | ALJ54471 | 1494 | 1595 | 1696, 1797, 1898, 1999, 2100, 2201, 2302 |
| 48 | ALJ54472 | 1495 | 1596 | 1697, 1798, 1899, 2000, 2101, 2202, 2303 |
| 49 | ALJ54474 | 1496 | 1597 | 1698, 1799, 1900, 2001, 2102, 2203, 2304 |
| 50 | ALJ54483 | 1497 | 1598 | 1699, 1800, 1901, 2002, 2103, 2204, 2305 |
| 51 | ALJ54486 | 1498 | 1599 | 1700, 1801, 1902, 2003, 2104, 2205, 2306 |
| 52 | ALJ54488 | 1499 | 1600 | 1701, 1802, 1903, 2004, 2105, 2206, 2307 |
| 53 | ALJ54490 | 1500 | 1601 | 1702, 1803, 1904, 2005, 2106, 2207, 2308 |
| 54 | ALJ54495 | 1501 | 1602 | 1703, 1804, 1905, 2006, 2107, 2208, 2309 |
| 55 | ALJ54496 | 1502 | 1603 | 1704, 1805, 1906, 2007, 2108, 2209, 2310 |
| 56 | ALJ54500 | 1503 | 1604 | 1705, 1806, 1907, 2008, 2109, 2210, 2311 |
| 57 | ALJ54501 | 1504 | 1605 | 1706, 1807, 1908, 2009, 2110, 2211, 2312 |
| 58 | ALJ54502 | 1505 | 1606 | 1707, 1808, 1909, 2010, 2111, 2212, 2313 |
| 59 | ALJ54512 | 1506 | 1607 | 1708, 1809, 1910, 2011, 2112, 2213, 2314 |
| 60 | ALJ54517 | 1507 | 1608 | 1709, 1810, 1911, 2012, 2113, 2214, 2315 |
| 61 | ALJ54518 | 1508 | 1609 | 1710, 1811, 1912, 2013, 2114, 2215, 2316 |
| 62 | ALW82691 | 1509 | 1610 | 1711, 1812, 1913, 2014, 2115, 2216, 2317 |
| 63 | ALW82742 | 1510 | 1611 | 1712, 1813, 1914, 2015, 2116, 2217, 2318 |
| 64 | ALW82753 | 1511 | 1612 | 1713, 1814, 1915, 2016, 2117, 2218, 2319 |
| 65 | ALX27228 | 1512 | 1613 | 1714, 1815, 1916, 2017, 2118, 2219, 2320 |
| 66 | ALX27232 | 1513 | 1614 | 1715, 1816, 1917, 2018, 2119, 2220, 2321 |
| 67 | AMQ48993 | 1514 | 1615 | 1716, 1817, 1918, 2019, 2120, 2221, 2322 |
| 68 | AMW90844 | 1515 | 1616 | 1717, 1818, 1919, 2020, 2121, 2222, 2323 |
| 69 | AMW90852 | 1516 | 1617 | 1718, 1819, 1920, 2021, 2122, 2223, 2324 |
| 70 | AMW90853 | 1517 | 1618 | 1719, 1820, 1921, 2022, 2123, 2224, 2325 |
| 71 | ANC28656 | 1518 | 1619 | 1720, 1821, 1922, 2023, 2124, 2225, 2326 |
| 72 | ANC28678 | 1519 | 1620 | 1721, 1822, 1923, 2024, 2125, 2226, 2327 |
| 73 | AHL18090 | 1520 | 1621 | 1722, 1823, 1924, 2025, 2126, 2227, 2328 |
| 74 | AHX00731 | 1521 | 1622 | 1723, 1824, 1925, 2026, 2127, 2228, 2329 |
| 75 | AHX71946 | 1522 | 1623 | 1724, 1825, 1926, 2027, 2128, 2229, 2330 |
| 76 | AHY22545 | 1523 | 1624 | 1725, 1826, 1927, 2028, 2129, 2230, 2331 |
| 77 | AHY22555 | 1524 | 1625 | 1726, 1827, 1928, 2029, 2130, 2231, 2332 |
| 78 | AHY22565 | 1525 | 1626 | 1727, 1828, 1929, 2030, 2131, 2232, 2333 |
| 79 | AJG44069 | 1526 | 1627 | 1728, 1829, 1930, 2031, 2132, 2233, 2334 |
| 80 | AJG44080 | 1527 | 1628 | 1729, 1830, 1931, 2032, 2133, 2234, 2335 |
| 81 | AJG44102 | 1528 | 1629 | 1730, 1831, 1932, 2033, 2134, 2235, 2336 |
| 82 | AJG44124 | 1529 | 1630 | 1731, 1832, 1933, 2034, 2135, 2236, 2337 |
| 83 | ALL26396 | 1530 | 1631 | 1732, 1833, 1934, 2035, 2136, 2237, 2338 |
| 84 | ALS20350 | 1531 | 1632 | 1733, 1834, 1935, 2036, 2137, 2238, 2339 |
| 85 | ALT66880 | 1532 | 1633 | 1734, 1835, 1936, 2037, 2138, 2239, 2340 |
| 86 | ALA49341 | 1533 | 1634 | 1735, 1836, 1937, 2038, 2139, 2240, 2341 |
| 87 | ALA49352 | 1534 | 1635 | 1736, 1837, 1938, 2039, 2140, 2241, 2342 |
| 88 | ALA49363 | 1535 | 1636 | 1737, 1838, 1939, 2040, 2141, 2242, 2343 |
| 89 | ALA49374 | 1536 | 1637 | 1738, 1839, 1940, 2041, 2142, 2243, 2344 |
| 90 | ALA49396 | 1537 | 1638 | 1739, 1840, 1941, 2042, 2143, 2244, 2345 |

TABLE 7-continued

MERS coronavirus spike protein S1 (S1):

| Row | column 1<br>NCBI Accession No. | column 2<br>A | column 3<br>B | column 4<br>C |
|---|---|---|---|---|
| 91 | ALA49451 | 1538 | 1639 | 1740, 1841, 1942, 2043, 2144, 2245, 2346 |
| 92 | ALA49473 | 1539 | 1640 | 1741, 1842, 1943, 2044, 2145, 2246, 2347 |
| 93 | ALA49583 | 1540 | 1641 | 1742, 1843, 1944, 2045, 2146, 2247, 2348 |
| 94 | ALA49649 | 1541 | 1642 | 1743, 1844, 1945, 2046, 2147, 2248, 2349 |
| 95 | ALA49660 | 1542 | 1643 | 1744, 1845, 1946, 2047, 2148, 2249, 2350 |
| 96 | ALA49671 | 1543 | 1644 | 1745, 1846, 1947, 2048, 2149, 2250, 2351 |
| 97 | ALA49682 | 1544 | 1645 | 1746, 1847, 1948, 2049, 2150, 2251, 2352 |
| 98 | ALA49803 | 1545 | 1646 | 1747, 1848, 1949, 2050, 2151, 2252, 2353 |
| 99 | ALA49836 | 1546 | 1647 | 1748, 1849, 1950, 2051, 2152, 2253, 2354 |
| 100 | ALA49957 | 1547 | 1648 | 1749, 1850, 1951, 2052, 2153, 2254, 2355 |
| 101 | ALA50067 | 1548 | 1649 | 1750, 1851, 1952, 2053, 2154, 2255, 2356 |

In a preferred embodiment, the mRNA according to the invention comprises at least one coding region encoding at least one antigenic peptide or protein comprising or consisting of a spike S1 fragment (S1), of a MERS coronavirus, or a fragment or variant thereof, which comprises or consists of an amino acid sequence selected from any one of the amino acid sequences according to SEQ ID NO: 1448-1548, or a fragment or variant of any one of these amino acid sequences. More preferably, the at least one encoded antigenic peptide or protein comprises or consists of an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the amino acid sequences according to SEQ ID NO: 1448-1548.

In this context, it is preferred that the mRNA according to the invention comprises at least one coding region comprising or consisting of an RNA sequence according to SEQ ID NO: 1549-1649, or a fragment or variant thereof. Preferably, the at least one coding region comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 1549-1649.

In a preferred embodiment, the mRNA according to the invention comprises at least one coding region encoding at least one antigenic peptide or protein comprising or consisting of an envelope protein (E) of a MERS coronavirus, or a fragment or variant thereof, which comprises or consists of an amino acid sequence selected from any one of the amino acid sequences according to SEQ ID NO: 102 to 108, or a fragment or variant of any one of these amino acid sequences. More preferably, the at least one encoded antigenic peptide or protein comprises or consists of an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the amino acid sequences according to SEQ ID NO: 102 to 108.

Preferably, the mRNA according to the invention comprises at least one coding region comprising or consisting of an RNA sequence according to SEQ ID NO: 254 to 260, or a fragment or variant thereof. More preferably, the at least one coding region comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 254 to 260.

TABLE 2

MERS coronavirus envelope (E) protein:

| Row | column 1<br>NCBI Accession No. | column 2<br>A | column 3<br>B | column 4<br>C |
|---|---|---|---|---|
| 1 | AGH58723 | 102 | 254 | 406, 558, 710, 862, 1014, 1166, 1318 |
| 2 | AGV08472 | 103 | 255 | 407, 559, 711, 863, 1015, 1167, 1319 |
| 3 | AGV08540 | 104 | 256 | 408, 560, 712, 864, 1016, 1168, 1320 |
| 4 | ALX27237 | 105 | 257 | 409, 561, 713, 865, 1017, 1169, 1321 |
| 5 | ALR69646 | 106 | 258 | 410, 562, 714, 866, 1018, 1170, 1322 |
| 6 | ALA49346 | 107 | 259 | 411, 563, 715, 867, 1019, 1171, 1323 |
| 7 | ALA49390 | 108 | 260 | 412, 564, 716, 868, 1020, 1172, 1324 |

TABLE 3

MERS coronavirus membrane (M) protein:

| Row | column 1<br>NCBI Accession No. | column 2<br>A | column 3<br>B | column 4<br>C |
|---|---|---|---|---|
| 1 | AFS88942 | 109 | 261 | 413, 565, 717, 869, 1021, 1173, 1325 |
| 2 | AGH58718 | 110 | 262 | 414, 566, 718, 870, 1022, 1174, 1326 |
| 3 | AGV08396 | 111 | 263 | 415, 567, 719, 871, 1023, 1175, 1327 |
| 4 | AGV08590 | 112 | 264 | 416, 568, 720, 872, 1024, 1176, 1328 |
| 5 | AHI48567 | 113 | 265 | 417, 569, 721, 873, 1025, 1177, 1329 |
| 6 | AHI48589 | 114 | 266 | 418, 570, 722, 874, 1026, 1178, 1330 |
| 7 | AIL23940 | 115 | 267 | 419, 571, 723, 875, 1027, 1179, 1331 |
| 8 | AKM76245 | 116 | 268 | 420, 572, 724, 876, 1028, 1180, 1332 |
| 9 | ALW82726 | 117 | 269 | 421, 573, 725, 877, 1029, 1181, 1333 |
| 10 | ALX27238 | 118 | 270 | 422, 574, 726, 878, 1030, 1182, 1334 |
| 11 | AMQ49021 | 119 | 271 | 423, 575, 727, 879, 1031, 1183, 1335 |
| 12 | AJG44108 | 120 | 272 | 424, 576, 728, 880, 1032, 1184, 1336 |
| 13 | ALA49369 | 121 | 273 | 425, 577, 729, 881, 1033, 1185, 1337 |
| 14 | ALA49424 | 122 | 274 | 426, 578, 730, 882, 1034, 1186, 1338 |
| 15 | ALA49908 | 123 | 275 | 427, 579, 731, 883, 1035, 1187, 1339 |
| 16 | ALA49963 | 124 | 276 | 428, 580, 732, 884, 1036, 1188, 1340 |

According to one embodiment, the mRNA according to the invention comprises at least one coding region encoding at least one antigenic peptide or protein comprising or consisting of a membrane protein (M) of a MERS coronavirus, or a fragment or variant thereof, which comprises or consists of an amino acid sequence selected from any one of the amino acid sequences according to SEQ ID NO: 109 to 124, or a fragment or variant of any one of these amino acid sequences. More preferably, the at least one encoded antigenic peptide or protein comprises or consists of an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the amino acid sequences according to SEQ ID NO: 109 to 124.

It is further preferred that the mRNA according to the invention comprises at least one coding region comprising or consisting of an RNA sequence according to SEQ ID NO: 261 to 276, or a fragment or variant thereof. Preferably, the at least one coding region comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 261 to 276.

TABLE 4

MERS coronavirus nucleocapsid (N) protein:

| Row | column 1<br>NCBI Accession No. | column 2<br>A | column 3<br>B | column 4<br>C |
|---|---|---|---|---|
| 1 | AFS88943 | 125 | 277 | 429, 581, 733, 885, 1037, 1189, 1341 |
| 2 | AFY13314 | 126 | 278 | 430, 582, 734, 886, 1038, 1190, 1342 |
| 3 | AGH58724 | 127 | 279 | 431, 583, 735, 887, 1039, 1191, 1343 |
| 4 | AGV08397 | 128 | 280 | 432, 584, 736, 888, 1040, 1192, 1344 |
| 5 | AGV08415 | 129 | 281 | 433, 585, 737, 889, 1041, 1193, 1345 |
| 6 | AGV08487 | 130 | 282 | 434, 586, 738, 890, 1042, 1194, 1346 |
| 7 | AHC74095 | 131 | 283 | 435, 587, 739, 891, 1043, 1195, 1347 |
| 8 | AHI48535 | 132 | 284 | 436, 588, 740, 892, 1044, 1196, 1348 |
| 9 | AIL23941 | 133 | 285 | 437, 589, 741, 893, 1045, 1197, 1349 |
| 10 | AIL23996 | 134 | 286 | 438, 590, 742, 894, 1046, 1198, 1350 |
| 11 | AIY60565 | 135 | 287 | 439, 591, 743, 895, 1047, 1199, 1351 |
| 12 | AIZ74424 | 136 | 288 | 440, 592, 744, 896, 1048, 1200, 1352 |
| 13 | AIZ74430 | 137 | 289 | 441, 593, 745, 897, 1049, 1201, 1353 |
| 14 | AKI29291 | 138 | 290 | 442, 594, 746, 898, 1050, 1202, 1354 |
| 15 | AKK52599 | 139 | 291 | 443, 595, 747, 899, 1051, 1203, 1355 |
| 16 | AKN24774 | 140 | 292 | 444, 596, 748, 900, 1052, 1204, 1356 |
| 17 | ALW82676 | 141 | 293 | 445, 597, 749, 901, 1053, 1205, 1357 |
| 18 | AMQ49033 | 142 | 294 | 446, 598, 750, 902, 1054, 1206, 1358 |
| 19 | AHL18098 | 143 | 295 | 447, 599, 751, 903, 1055, 1207, 1359 |
| 20 | AHX00738 | 144 | 296 | 448, 600, 752, 904, 1056, 1208, 1360 |
| 21 | AHY22561 | 145 | 297 | 449, 601, 753, 905, 1057, 1209, 1361 |
| 22 | AHY22571 | 146 | 298 | 450, 602, 754, 906, 1058, 1210, 1362 |
| 23 | ALA49381 | 147 | 299 | 451, 603, 755, 907, 1059, 1211, 1363 |
| 24 | ALA49392 | 148 | 300 | 452, 604, 756, 908, 1060, 1212, 1364 |
| 25 | ALA49601 | 149 | 301 | 453, 605, 757, 909, 1061, 1213, 1365 |

TABLE 4-continued

MERS coronavirus nucleocapsid (N) protein:

| Row | column 1<br>NCBI Accession No. | column 2<br>A | column 3<br>B | column 4<br>C |
|---|---|---|---|---|
| 26 | ALA49843 | 150 | 302 | 454, 606, 758, 910, 1062, 1214, 1366 |
| 27 | ALA49865 | 151 | 303 | 455, 607, 759, 911, 1063, 1215, 1367 |
| 28 | ALA49909 | 152 | 304 | 456, 608, 760, 912, 1064, 1216, 1368 |

In one embodiment, the mRNA according to the invention comprises at least one coding region encoding at least one antigenic peptide or protein comprising or consisting of a nucleocapsid protein (N) of a MERS coronavirus, or a fragment or variant thereof, which comprises or consists of an amino acid sequence selected from any one of the amino acid sequences according to SEQ ID NO: 125 to 152, or a fragment or variant of any one of these amino acid sequences. More preferably, the at least one encoded antigenic peptide or protein comprises or consists of an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the amino acid sequences according to SEQ ID NO: 125 to 152.

Preferably, the mRNA according to the invention comprises at least one coding region comprising or consisting of an RNA sequence according to SEQ ID NO: 277 to 304, or a fragment or variant thereof. More preferably, the at least one coding region comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 277 to 304.

According to a preferred embodiment, the mRNA according to the invention comprises at least one coding region encoding at least one antigenic peptide or protein comprising or consisting of a spike protein (S) of a MERS coronavirus as described herein, or a fragment or variant thereof. Preferably, the antigenic peptide or protein comprises or consists of a spike S1 fragment (S1), (the S1 subunit of a spike protein (S)) of a MERS coronavirus, or a fragment or variant thereof as defined herein. More preferably, the antigenic peptide or protein comprises or consists of the receptor binding domain (RBD) of the S1 subunit of a spike protein (S) of a MERS coronavirus, or a fragment or variant thereof. In addition, the at least one coding region preferably encodes at least one antigenic peptide or protein comprising or consisting of a nucleocapsid protein (N), a membrane protein (M) and/or an envelope protein (E) of a MERS coronavirus, or a fragment or variant of any one of these proteins as described herein.

MERS coronavirus full length spike (S) protein consist of 1353 amino acids (see Table 1, Column A). In specific embodiments, full length spike (S) protein according to SEQ ID NOs: 1-101 is modified in such a way that the prototypical prefusion conformation is stabilized. Stabilization of the prefusion conformation is preferably obtained by introducing two consecutive proline substitutions at residues 1060 and 1061 in the full length spike protein. Specifically, spike (5) protein stabilized proteins (S_stabilized) are obtained in a way that the amino acid residue at position 1060 is exchanged to Proline and the amino acid residue at position 1061 is also exchanged to Proline.

One particular example of that embodiment is a protein according to SEQ ID NO: 2357 or 2359. In these S_stabilized proteins, the respective amino acid residues at position 1060 (Valine) and 1061 (Lysine) are both changed to Proline (V1060P,K1061P).

Accordingly, the mRNA of the invention comprises at least one coding region comprising or consisting of an RNA sequence encoding an amino acid sequence according to SEQ ID NOs: 1-101, wherein the respective amino acid sequences according to SEQ ID NOs: 1-101 are modified by changing the amino acid residue at position 1060 to Proline and the amino acid residue at position 1061 to Proline, or a fragment or variant thereof.

According to particularly preferred embodiments, the inventive mRNA further encodes a secretory signal peptide, said secretory signal peptide preferably being fused to the antigenic peptide or protein encoded by the at least one coding region of the inventive mRNA.

Such signal peptides are sequences, which typically exhibit a length of about 15 to 30 amino acids and are preferably located at the N—terminus of the encoded peptide, without being limited thereto. Signal peptides as defined herein preferably allow the transport of the antigenic peptide or protein as encoded by the inventive mRNA into a defined cellular compartment, preferably the cell surface, the endoplasmic reticulum (ER) or the endosomal-lysosomal compartment. Examples of secretory signal peptide sequences as defined herein include, without being limited thereto, signal sequences of classical or non-classical MHC-molecules (e.g. signal sequences of MHC I and II molecules, e.g. of the MHC class I molecule HLA-A*0201), signal sequences of cytokines or immunoglobulins, signal sequences of the invariant chain of immunoglobulins or antibodies, signal sequences of Lamp1, Tapasin, Erp57, Calretikulin, Calnexin, PLAT, EPO or albumin and further membrane associated proteins or of proteins associated with the endoplasmic reticulum (ER) or the endosomal-lysosomal compartment.

Particularly preferred signal peptides are those derived from human HLA-A2 (amino acids 1-24), human PLAT (amino acids 1-23, 1-21 or 1-22), human EPO (amino acids 1-27), human ALB (amino acids 1-18), human IgE, human CD5 (amino acids 1-24), human IL2 (amino acids 1-20), human CTRB2 (amino acids 1-18), human IgG-HC (amino acids 1-19), human Ig-HC (amino acids 1-19), human Ig-LC (amino acids 1-19), *Gaussia princeps* Luc (amino acids 1-17), mouse Igkappa, NrChit1 (1-26), CILp1.1 (1-21), *Nepenthes rafflesiana* Nep1 (amino acids 1-24), human Azu1 (amino acids 1-19), human CD33 (amino acids 1-16), *Vibrio cholera* CtxB (amino acids 1-19), human CST4

(amino acids 1-20), human Ins-iso1 (amino acids 1-24), human SPARC (amino acids 1-17), or Influenza A SP-H1N1 (Netherlands2009)—HA.

Such signal peptides are preferably used in order to promote secretion of the encoded antigenic peptide or protein. More preferably, a signal peptide as defined herein is fused to an encoded antigenic peptide or protein as defined herein.

Accordingly, in particularly preferred embodiments, the inventive mRNA comprises at least one coding region encoding at least one antigenic peptide or protein and a signal peptide as defined herein, said signal peptide preferably being fused to the at least one antigenic peptide or protein, more preferably to the N—terminus of the at least one antigenic peptide or protein as described herein, wherein the signal peptide preferably comprises or consists of an amino acid sequence as defined by SEQ ID NO: 1392-1416, or a variant or fragment of any one of these amino acid sequences. Such variants or fragments are preferably functional, i.e. exhibit the same desired biological function as the signal peptides they are derived from, and are thus preferably capable of mediating secretion of the fused antigenic protein or peptide.

Accordingly, in a particularly preferred embodiment, the inventive mRNA comprises at least one coding region encoding at least one antigenic peptide or protein and a signal peptide HsIgE according to SEQ ID NO: 2358, 2359 or 2360.

According to further particularly preferred embodiments, the inventive mRNA further encodes a transmembrane domain. The sequence encoding the transmembrane domain is preferably joined to the sequence encoding the antigenic peptide or protein, so that said peptide or protein is expressed as a fusion protein comprising said transmembrane domain.

Transmembrane domains (TMDs) consist of amino acid sequences, which preferably form three-dimensional protein structures that span the lipid bilayer. TMDs are typically about 20 amino acids in length and can form a single alpha helix, a transmembrane beta barrel, a beta-helix of gramicidin A, or any other structure.

Transmembrane domains as defined herein preferably anchor the fused antigenic protein or peptide in a membrane. Such transmembrane domains may be useful to ensure that the antigenic proteins or peptides are membrane-bound and thus accessible for the immune system.

Particularly preferred transmembrane domains are those derived from Influenza virus, Human immunodeficiency virus 1, equine infectious anemia virus, murine leukemia virus, mouse mammary tumor virus, vesicular stomatitis virus and rabies virus.

According to particularly preferred embodiments, the inventive mRNA comprises a coding region encoding a TMD as defined herein. Said coding region is preferably joined to or comprised by the coding region encoding the antigenic peptide or protein as defined herein, so that the antigenic protein or peptide is expressed as a fusion protein comprising the encoded TMD.

Accordingly, particularly preferred embodiments, the inventive mRNA additionally comprises at least one coding region encoding a TMD as defined herein, said TMD preferably comprising or consisting of an amino acid sequence as defined by SEQ ID NO: 1417-1428, or a variant or fragment thereof. Such variants or fragments are preferably functional, i.e. exhibit the same desired biological function as the TMDs they are derived from, and are thus preferably capable of anchoring the fused antigenic protein or peptide in a membrane. Said membrane can be a cellular membrane or a virus-like particle membrane.

According to further particularly preferred embodiments, the inventive mRNA further encodes a VLP-forming domain. The sequence encoding the VLP-forming domains preferably joined to the sequence encoding the antigenic peptide or protein, so that said peptide or protein is expressed as a fusion protein comprising said VLP-forming domain.

VLP-forming domains are capable of mediating the formation of virus-like particles (VLPs), i.e. non-infectious assemblies of viral structural proteins. VLPs preferably contain repetitive, high density displays of viral structural proteins that can elicit strong adaptive immune responses.

VLP-forming domains can therefore be fused to antigenic peptides or proteins as defined herein in order to mediate their assembly into VLPs. Particularly preferred VLP-forming domains are those derived from Woodchuck hepatitis virus and Alfalfa mosaic virus.

According to particularly preferred embodiments, the inventive RNA comprises a coding region encoding a VLP-forming domain as defined herein. Said coding region is preferably joined to or comprised by the coding region encoding the antigenic peptide or protein as defined herein, so that the antigenic protein or peptide is expressed as a fusion protein comprising the encoded VLP-forming domain.

Accordingly, particularly preferred embodiments, the inventive mRNA additionally comprises at least one coding region encoding a VLP-forming domain as defined herein, said TMD preferably comprising or consisting of an amino acid sequence as defined by SEQ ID NO: 1429 or 1430, or a variant or fragment thereof. Such variants or fragments are preferably functional, i.e. exhibit the same desired biological function as the VLP-forming domains they are derived from, and are thus preferably capable of mediating the assembly of the fused antigenic proteins or peptides into VLPs.

In preferred embodiments, the mRNA according to the invention comprises at least one coding region encoding at least one antigenic peptide or protein, wherein the antigenic peptide or protein preferably comprises a spike protein, or a fragment or variant thereof, more preferably the receptor binding domain (RBD) derived from a spike protein, of a MERS coronavirus and, additionally, at least one selected from the group consisting of a signal peptide, a transmembrane domain and a VLP-forming domain as described herein. Preferably, the mRNA according to the invention encodes at least one antigenic peptide or protein as described herein, which is fused, preferably at its N-terminus, with a signal peptide, a transmembrane domain or a VLP-forming domain as described herein. More preferably, the mRNA encodes an antigenic peptide or protein that preferably comprises or consists of a MERS coronavirus spike protein as described herein, more preferably comprising or consisting of the receptor binding domain (RBD) derived from a spike protein, wherein the antigenic peptide or protein is fused, preferably at its N-terminus, with a signal peptide, a transmembrane domain or a VLP-forming domain as described herein.

According to certain embodiments of the present invention, the mRNA is mono-, bi-, or multicistronic, preferably as defined herein. The coding sequences in a bi- or multicistronic mRNA preferably encode distinct peptides or proteins as defined herein or a fragment or variant thereof. Preferably, the coding sequences encoding two or more peptides or proteins may be separated in the bi- or multicistronic mRNA by at least one IRES (internal ribosomal entry site) sequence, as defined below. Thus, the term "encoding two or more peptides or proteins" may mean, without being limited thereto, that the bi- or even multicistronic mRNA, may encode e.g. at least two, three, four, five, six or more (preferably different) peptides or proteins or their fragments or variants within the definitions provided herein. More preferably, without being limited thereto, the bi- or even multicistronic mRNA, may encode, for example, at least two, three, four, five, six or more (preferably different) peptides or proteins as defined herein or their fragments or variants as defined herein. In this context, a so-called IRES (internal ribosomal entry site) sequence as defined above can function as a sole ribosome binding site, but it can also serve to provide a bi- or even multicistronic mRNA as defined above, which encodes several peptides or proteins which are to be translated by the ribosomes independently of one another. Examples of IRES sequences, which can be used according to the invention, are those from picornaviruses (e.g. FMDV), pestiviruses (CFFV), polioviruses (PV), encephalomyocarditis viruses (ECMV), foot and mouth disease viruses (FMDV), hepatitis C viruses (HCV), classical swine fever viruses (CSFV), mouse leukoma virus (MLV), simian immunodeficiency viruses (SIV) or cricket paralysis viruses (CrPV). Preferably, an IRES sequence as used herein comprises or consists of a nucleic acid sequence according to SEQ ID NO: 1438 or 1439, or a fragment or variant thereof.

According to a further embodiment the at least one coding region of the mRNA according to the invention may encode at least two, three, four, five, six, seven, eight and more peptides or proteins (or fragments and derivatives thereof) as defined herein linked with or without an amino acid linker sequence, wherein said linker sequence can comprise rigid linkers, flexible linkers, cleavable linkers (e.g., self-cleaving peptides) or a combination thereof. Therein, the peptides or proteins may be identical or different or a combination thereof. Particular peptide or protein combinations can be encoded by said mRNA encoding at least two peptides or proteins as explained herein (also referred to herein as "multi-antigen-constructs/mRNA").

In some embodiments, the at least one coding region of the mRNA according to the invention encodes at least two, three, four, five, six, seven, eight or more antigenic peptides or proteins comprising or consisting of MERS coronavirus protein, or a fragment or variant thereof. More preferably, the at least one coding region encodes at least two, three, four, five, six, seven, eight or more antigenic peptides or proteins comprising or consisting of a spike protein (S or S_stabilized), a spike S1 fragment (S1), a nucleocapsid protein (N), a membrane protein (M) or an envelope protein (E) of a MERS coronavirus, or a fragment or variant of any one of these proteins. Even more preferably, the at least one coding region encodes at least two, three, four, five, six, seven, eight or more amino acid sequences selected from the group consisting of SEQ ID NO: 1 to 152 or 1448-1548, or a fragment or variant of any one of these amino acid sequences.

Preferably, the at least one coding region of the mRNA sequence according to the invention comprises at least two, three, four, five, six, seven, eight or more nucleic acid sequences identical to or having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably of at least 85%, even more preferably of at least 90% and most preferably of at least 95% or even 97%, with any one of the nucleic acid sequences disclosed in columns 3 and 4 of Tables 1-4 and Table Therein, or a fragment or variant of any one of said nucleic acid sequences.

Preferably, the mRNA sequence comprising at least one coding region as defined herein typically comprises a length of about 50 to about 20000, or 100 to about 20000 nucleotides, preferably of about 250 to about 20000 nucleotides, more preferably of about 500 to about 10000, even more preferably of about 500 to about 5000.

Circular RNA:

In embodiments, the mRNA is an RNA, in particular a circular RNA. As used herein, "circular RNA" has to be understood as a circular polynucleotide that can encode at least one antigenic peptide or protein as defined herein. Accordingly, in preferred embodiments, said circular RNA comprises at least one coding sequence encoding at least one antigenic peptide or protein derived from a Mers virus or a fragment or variant thereof as defined herein.

The production of circRNAs can be performed using various methods provided in the art. For example, U.S. Pat. No. 6,210,931 teaches a method of synthesizing circRNAs by inserting DNA fragments into a plasmid containing sequences having the capability of spontaneous cleavage and self-circularization. U.S. Pat. No. 5,773,244 teaches producing circRNAs by making a DNA construct encoding an RNA cyclase ribozyme, expressing the DNA construct as an RNA, and then allowing the RNA to self-splice, which produces a circRNA free from intron in vitro. WO1992001813 teaches a process of making single strand circular nucleic acids by synthesizing a linear polynucleotide, combining the linear nucleotide with a complementary linking oligonucleotide under hybridization conditions, and ligating the linear polynucleotide. The person skilled in the art may also use methods provided in WO2015034925 or WO2016011222 to produce circular RNA. Accordingly, methods for producing circular RNA as provided in U.S. Pat. Nos. 6,210,931, 5,773,244, WO1992001813, WO2015034925 and WO2016011222 are incorporated herewith by reference.

RNA In Vitro Transcription and RNA Purification:

The mRNA according to the present invention may be prepared using any method known in the art, including chemical synthesis such as e.g. solid phase RNA synthesis, as well as in vitro methods, such as RNA in vitro transcription reactions.

In a preferred embodiment, the artificial nucleic acid as defined herein, preferably the RNA as defined herein, is obtained by RNA in vitro transcription. Accordingly, the RNA of the invention is preferably an in vitro transcribed RNA.

The terms "RNA in vitro transcription" or "in vitro transcription" relate to a process wherein RNA is synthesized in a cell-free system (in vitro) as defined above. DNA, particularly plasmid DNA (or PCR product), is typically used as template for the generation of RNA transcripts.

In embodiments, the nucleotide mixture used in RNA in vitro transcription may additionally contain modified nucleotides as defined herein. In embodiments, the nucleotide mixture (i.e. the fraction of each nucleotide in the mixture) may be optimized for the given RNA sequence, preferably as described WO2015/188,933.

In embodiment where more than one different artificial nucleic acid as defined herein has to be produced, e.g. where 2, 3, 4, 5, 6, 7, 8, 9, 10 or even more different artificial nucleic acids have to be produced (e.g. encoding different antigenic peptides, proteins of Mers virus), procedures as described in WO2017/109,134 may be suitably used.

In the context of nucleic acid vaccine production, it may be required to provide GMP-grade RNA. GMP-grade RNA may be suitably produced using a manufacturing process approved by regulatory authorities. Accordingly, in a particularly preferred embodiment, RNA production is performed under current good manufacturing practice (GMP), implementing various quality control steps on DNA and RNA level, according to WO2016/180,430. Accordingly, the RNA of the invention is a GMP-grade RNA, particularly a GMP-grade mRNA.

The obtained RNA products are preferably purified using PureMessenger® (CureVac, Tubingen, Germany; RP—HPLC according to WO2008/077,592) and/or tangential flow filtration (as described in WO2016/193,206).

In a preferred embodiment, the mRNA, particularly the purified mRNA, is lyophilized according to WO2016/165831 or WO2011/069,586 to yield a temperature stable dried artificial nucleic acid (powder) as defined herein. The mRNA of the invention, particularly the purified mRNA may also be dried using spray-drying or spray-freeze drying according to WO2016/184,575 or WO2016184576 to yield a temperature stable artificial nucleic acid (powder) as defined herein. Accordingly, in the context of manufacturing and purifying nucleic acids, particularly RNA, the disclosures of WO2017/109,161, WO2015/188,933, WO2016/180,430, WO2008/077,592, WO2016/193,206, WO2016/165,831, WO2011/069,586, WO2016/184,575, and WO2016/184,576 are incorporated herewith by reference.

Accordingly, in preferred embodiments the mRNA is a dried mRNA.

The term "dried mRNA" as used herein has to be understood as mRNA that has been lyophilized, or spray-dried, or spray-freeze dried as defined above to obtain a temperature stable dried mRNA (powder).

Accordingly, in preferred embodiments the mRNA is a purified mRNA

The term "purified mRNA" as used herein has to be understood as mRNA which has a higher purity after certain purification steps (e.g. HPLC, TFF, precipitation steps) than the starting material (e.g. in vitro transcribed RNA). Typical impurities that are essentially not present in purified RNA comprise peptides or proteins (e.g. enzymes derived from DNA dependent RNA in vitro transcription, e.g. RNA polymerases, RNases, BSA, pyrophosphatase, restriction endonuclease, DNase), spermidine, abortive RNA sequences, RNA fragments, free nucleotides (modified nucleotides, conventional NTPs, cap analogue), plasmid DNA fragments, buffer components (HEPES, TRIS, MgCl2) etc. Other impurities that may be derived from e.g. fermentation procedures comprise bacterial impurities (bioburden, bacterial DNA) or impurities derived from purification procedures (organic solvents etc.). Accordingly, it is desirable in this regard for the "degree of RNA purity" to be as close as possible to 100%. It is also desirable for the degree of RNA purity that the amount of full length RNA transcripts is as close as possible to 100%. Accordingly "purified RNA" as used herein has a degree of purity of more than 70%, 75%, 80%, 85%, very particularly 90%, 91%, 92%, 93%, 94%, 95%, 96%, 97%, 98% and most favorably 99% or more. The degree of purity may for example be determined by an analytical HPLC, wherein the percentages provided above correspond to the ratio between the area of the peak for the target RNA and the total area of all peaks representing the by-products. Alternatively, the degree of purity may for example be determined by an analytical agarose gel electrophoresis or capillary gel electrophoresis.

It has to be understood that "dried mRNA" as defined herein and "purified mRNA" as defined herein or "GMP-grade mRNA" as defined herein may have superior stability characteristics and improved efficiency (e.g. better translatability of the mRNA in vivo).

Modifications:

According to a further embodiment, the mRNA sequence according to the invention is an artificial mRNA sequence as defined herein, preferably a modified mRNA.

According to a further embodiment, the mRNA sequence according to the invention is a modified mRNA sequence, preferably a modified mRNA sequence as described herein. In this context, a modification as defined herein preferably leads to a stabilization of the mRNA sequence according to the invention. More preferably, the invention thus provides a stabilized mRNA sequence comprising at least one coding region as defined herein.

According to one embodiment, the mRNA sequence of the present invention may thus be provided as a "stabilized mRNA sequence", that is to say as an mRNA that is essentially resistant to in vivo degradation (e.g. by an exo- or endo-nuclease). Such stabilization can be effected, for example, by a modified phosphate backbone of the mRNA of the present invention. A backbone modification in connection with the present invention is a modification in which phosphates of the backbone of the nucleotides contained in the mRNA are chemically modified. Nucleotides that may be preferably used in this connection contain e.g. a phosphorothioate-modified phosphate backbone, preferably at least one of the phosphate oxygens contained in the phosphate backbone being replaced by a sulfur atom. Stabilized mRNAs may further include, for example: non-ionic phosphate analogues, such as, for example, alkyl and aryl phosphonates, in which the charged phosphonate oxygen is replaced by an alkyl or aryl group, or phosphodiesters and alkylphosphotriesters, in which the charged oxygen residue is present in alkylated form. Such backbone modifications typically include, without implying any limitation, modifications from the group consisting of methylphosphonates, phosphoramidates and phosphorothioates (e.g. cytidine-5'-O-(1-thiophosphate)).

In the following, specific modifications are described, which are preferably capable of "stabilizing" the mRNA as defined herein.

Chemical Modifications:

The term "mRNA modification" as used herein may refer to chemical modifications comprising backbone modifications as well as sugar modifications or base modifications.

In this context, a modified mRNA (sequence) as defined herein may contain nucleotide analogues/modifications, e.g. backbone modifications, sugar modifications or base modifications. A backbone modification in connection with the present invention is a modification, in which phosphates of the backbone of the nucleotides contained in an mRNA as defined herein are chemically modified. A sugar modification in connection with the present invention is a chemical modification of the sugar of the nucleotides of the mRNA as defined herein. Furthermore, a base modification in connection with the present invention is a chemical modification of the base moiety of the nucleotides of the mRNA. In this context, nucleotide analogues or modifications are preferably selected from nucleotide analogues, which are applicable for transcription and/or translation.

Sugar Modifications:

The modified nucleosides and nucleotides, which may be incorporated into a modified mRNA as described herein, can be modified in the sugar moiety. For example, the 2' hydroxyl group (OH) can be modified or replaced with a number of different "oxy" or "deoxy" substituents. Examples of "oxy"-2' hydroxyl group modifications include, but are not limited to, alkoxy or aryloxy (—OR, e.g., R=H, alkyl, cycloalkyl, aryl, aralkyl, heteroaryl or sugar); polyethyleneglycols (PEG), —O(CH$_2$CH$_2$O)nCH$_2$CH$_2$OR; "locked" nucleic acids (LNA) in which the 2' hydroxyl is connected, e.g., by a methylene bridge, to the 4 carbon of the same ribose sugar; and amino groups (—O-amino, wherein the amino group, e.g., NRR, can be alkylamino, dialkylamino, heterocyclyl, arylamino, diarylamino, heteroarylamino, or diheteroaryl amino, ethylene diamine, polyamino) or aminoalkoxy.

"Deoxy" modifications include hydrogen, amino (e.g. NH$_2$; alkylamino, dialkylamino, heterocyclyl, arylamino, diaryl amino, heteroaryl amino, diheteroaryl amino, or amino acid); or the amino group can be attached to the sugar through a linker, wherein the linker comprises one or more of the atoms C, N, and O.

The sugar group can also contain one or more carbons that possess the opposite stereochemical configuration than that of the corresponding carbon in ribose. Thus, a modified mRNA can include nucleotides containing, for instance, arabinose as the sugar.

Backbone Modifications:

The phosphate backbone may further be modified in the modified nucleosides and nucleotides, which may be incorporated into a modified mRNA as described herein. The phosphate groups of the backbone can be modified by replacing one or more of the oxygen atoms with a different substituent. Further, the modified nucleosides and nucleotides can include the full replacement of an unmodified phosphate moiety with a modified phosphate as described herein. Examples of modified phosphate groups include, but are not limited to, phosphorothioate, phosphoroselenates, borano phosphates, borano phosphate esters, hydrogen phosphonates, phosphoroamidates, alkyl or aryl phosphonates and phosphotriesters. Phosphorodithioates have both non-linking oxygens replaced by sulfur. The phosphate linker can also be modified by the replacement of a linking oxygen with nitrogen (bridged phosphoroamidates), sulfur (bridged phosphorothioates) and carbon (bridged methylene-phosphonates).

Base Modifications:

The modified nucleosides and nucleotides, which may be incorporated into a modified mRNA as described herein can further be modified in the nucleobase moiety. Examples of nucleobases found in mRNA include, but are not limited to, adenine, guanine, cytosine and uracil. For example, the nucleosides and nucleotides described herein can be chemically modified on the major groove face. In some embodiments, the major groove chemical modifications can include an amino group, a thiol group, an alkyl group, or a halo group.

In particularly preferred embodiments of the present invention, the nucleotide analogues/modifications are selected from base modifications, which are preferably selected from 2-amino-6-chloropurineriboside-5 triphosphate, 2-Aminopurine-riboside-5'-triphosphate; 2-aminoadenosine-5'-triphosphate, 2'-Amino-2'-deoxycytidine-triphosphate, 2-thiocytidine-5'-triphosphate, 2-thiouridine-5'-triphosphate, 2'-Fluorothymidine-5'-triphosphate, 2'-O-Methyl-inosine-5'-triphosphate 4-thiouridine-5-triphosphate, 6-aminoallylcytidine-5 triphosphate, 5-aminoallyluridine-5'-triphosphate, 5-bromocytidine-5'-triphosphate, 5-bromouridine-5'-triphosphate, 5-Bromo-2-deoxycytidine-5-triphosphate, 5-Bromo-2-deoxyuridine-5'-triphosphate, 5-iodocytidine-5-triphosphate, 5-Iodo-2'-deoxycytidine-5'-triphosphate, 5-iodouridine-5'-triphosphate, 5-Iodo-2'-deoxyuridine-5'-triphosphate, 5-methylcytidine-5'-triphosphate, 5-methyluridine-5'-triphosphate, 5-Propynyl-2-deoxycytidine-5-triphosphate, 5-Propynyl-2'-deoxyuridine-5'-triphosphate, 6-azacytidine-5 triphosphate, 6-azauridine-5'-triphosphate, 6-chloropurineriboside-5'-triphosphate, 7-deazadenosine-5 triphosphate, 7-deazaguanosine-5'-triphosphate, 8-azaadenine-5'-triphosphate, 8-azidoadenosine-5'-triphosphate, benzimidazole-riboside-5'-triphosphate, N1-methyladenosine-5'-triphosphate, N1-methylguanosine-5-triphosphate, N6-methyladenosine-5-triphosphate, O6-methylguanosine-5'-triphosphate, pseudouridine-5'-triphosphate, or puromycin-5'-triphosphate, xanthosine-5'-triphosphate. Particular preference is given to nucleotides for base modifications selected from the group of base-modified nucleotides consisting of 5-methylcytidine-5'-triphosphate, 7-deazaguanosine-5'-triphosphate, 5-bromocytidine-5'-triphosphate, and pseudouridine-5'-triphosphate.

In some embodiments, modified nucleosides include pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyluridine, 1-carboxymethyl-pseudouridine, 5-propynyluridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, and 4-methoxy-2-thio-pseudouridine.

In some embodiments, modified nucleosides include 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, and 4-methoxy-1-methyl-pseudoisocytidine.

In other embodiments, modified nucleosides include 2-aminopurine, 2,6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyladenosine, N6-methyladenosine, N6-isopentenyladenosine, N6-(cis-hydroxyisopentanyl)adenosine, 2-methylthio-N6-(cis-hydroxyisopentanyl) adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine.

In other embodiments, modified nucleosides include inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methylinosine, 6-methoxy-guanosine, 1-methylguanosine, N2-methylguanosine, N2,N2-dimethylguanosine, 8-oxoguanosine, 7-methyl-8-oxo-guanosine, 1-methyl-6-thio-guanosine, N2-methyl-6-thio-guanosine, and N2,N2-dimethyl-6-thio-guanosine.

In some embodiments, the nucleotide can be modified on the major groove face and can include replacing hydrogen on C-5 of uracil with a methyl group or a halo group. In specific embodiments, a modified nucleoside is 5'-O-(1-thiophosphate)-adenosine, 5'-O-(1-thiophosphate)-cytidine, 5'-O-(1-thiophosphate)-guanosine, 5'-O-(1-thiophosphate)-uridine or 5'-O-(1-thiophosphate)-pseudouridine.

In further specific embodiments, a modified mRNA may comprise nucleoside modifications selected from 6-aza-cytidine, 2-thio-cytidine, α-thio-cytidine, Pseudo-iso-cytidine, 5-aminoallyl-uridine, 5-iodo-uridine, N1-methyl-pseudouridine, 5,6-dihydrouridine, α-thio-uridine, 4-thio-uridine, 6-aza-uridine, 5-hydroxy-uridine, deoxy-thymidine, 5-methyl-uridine, Pyrrolo-cytidine, inosine, α-thio-guanosine, 6-methyl-guanosine, 5-methyl-cytidine, 8-oxo-guanosine, 7-deaza-guanosine, N1-methyl-adenosine, 2-amino-6-Chloro-purine, N6-methyl-2-amino-purine, Pseudo-iso-cytidine, 6-Chloro-purine, N6-methyl-adenosine, α-thio-adenosine, 8-azido-adenosine, 7-deaza-adenosine.

Lipid Modification:

According to a further embodiment, a modified mRNA as defined herein can contain a lipid modification. Such a lipid-modified mRNA typically comprises an mRNA as defined herein. Such a lipid-modified mRNA as defined herein typically further comprises at least one linker covalently linked with that mRNA, and at least one lipid covalently linked with the respective linker. Alternatively, the lipid-modified mRNA comprises at least one mRNA as defined herein and at least one (bifunctional) lipid covalently linked (without a linker) with that mRNA. According to a third alternative, the lipid-modified mRNA comprises an mRNA molecule as defined herein, at least one linker covalently linked with that mRNA, and at least one lipid covalently linked with the respective linker, and also at least one (bifunctional) lipid covalently linked (without a linker) with that mRNA. In this context, it is particularly preferred that the lipid modification is present at the terminal ends of a linear mRNA sequence.

Sequence Modifications:

In some embodiments of the invention, the G/C content of the coding region of the mRNA is increased compared to the G/C content of the corresponding coding sequence of the wild type mRNA, the C content of the coding region of the mRNA is increased compared to the C content of the corresponding coding sequence of the wild type mRNA, the codon usage in the coding region of the mRNA is adapted to the human codon usage, and/or the codon adaptation index (CAI) is increased or maximised in the coding region of the mRNA, wherein the amino acid sequence encoded by the mRNA according to the invention is preferably not being modified compared to the amino acid sequence encoded by the wild type mRNA.

In preferred embodiments, the mRNA according to the invention comprises at least one coding region encoding at least one antigenic peptide or protein comprising or consisting of a spike protein (S or S_stabilized), a spike S1 fragment (S1), an envelope protein (E), a membrane protein (M) or a nucleocapsid protein (N) of a MERS coronavirus, or a fragment or variant of any one of these proteins, wherein the mRNA, preferably the at least one coding region, comprises or consists of a (modified) nucleic acid sequence selected from SEQ ID NO: 305-1368, or 1650-2356, 2365 or 2366 or a nucleid acid sequence listed in column 4 of Tables 1-4 and of Table 7, or a fragment or variant of any one of these nucleic acid sequences. Preferably, the at least one coding region comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 305-1368, or 1650-2356, 2365 or 2366 or with any one of the nucleic acid sequences listed in column 4 of Tables 1-4 and Table 7.

According to a preferred embodiment, the at least one coding region of the inventive mRNA encodes an antigenic peptide or protein comprising or consisting of a spike protein (S or S_stabilized) of a MERS coronavirus, or a fragment or variant thereof, wherein the at least one coding region comprises or consists of an RNA sequence according to any one of SEQ ID NO: 305 to 405 and 2365, 457 to 557, 609 to 709, 761 to 861, 913 to 1013, 1065 to 1165 or 1217 to 1317, or a fragment or variant of any one of these RNA sequences. Preferably, the at least one coding region comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 305 to 405 and 2365, 457 to 557, 609 to 709, 761 to 861, 913 to 1013, 1065 to 1165 or 1217 to 1317.

According to a preferred embodiment, the at least one coding region of the inventive mRNA encodes an antigenic peptide or protein comprising or consisting of a S1 subunit of a spike protein (51) of a MERS coronavirus, or a fragment or variant thereof, wherein the at least one coding region comprises or consists of an RNA sequence according to any one of SEQ ID NO: 1650 to 1750 or 2366, 1751 to 1851, 1852 to 1952, 1953 to 2053, 2054 to 2154, 2155 to 2255, or 2256 to 2356, or a fragment or variant of any one of these RNA sequences. Preferably, the at least one coding region comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 1650 to 1750 or 2366, 1751 to 1851, 1852 to 1952, 1953 to 2053, 2054 to 2154, 2155 to 2255, or 2256 to 2356.

It is further preferred that the at least one coding region of the inventive mRNA encodes an antigenic peptide or protein comprising or consisting of envelope protein (E) of a MERS coronavirus, or a fragment or variant thereof, wherein the at least one coding region comprises or consists of an RNA sequence according to any one of SEQ ID NO: 406 to 412, 558 to 564, 710 to 716, 862 to 868, 1014 to 1020, 1166 to 1172 or 1318 to 1324, or a fragment or variant of any one of these RNA sequences. More preferably, the at least one coding region comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 406 to 412, 558 to 564, 710 to 716, 862 to 868, 1014 to 1020, 1166 to 1172 or 1318 to 1324.

According to some embodiments, the at least one coding region of the inventive mRNA encodes an antigenic peptide or protein comprising or consisting of a membrane protein (M) of a MERS coronavirus, or a fragment or variant thereof, wherein the at least one coding region comprises or consists of an RNA sequence according to any one of SEQ ID NO: 413 to 428, 565 to 580, 717 to 732, 869 to 884, 1021 to 1036, 1173 to 1188 or 1325 to 1340, or a fragment or variant of any one of these RNA sequences. Preferably, the at least one coding region comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 413 to 428, 565 to 580, 717 to 732, 869 to 884, 1021 to 1036, 1173 to 1188 or 1325 to 1340.

It is further preferred that the at least one coding region of the inventive mRNA encodes an antigenic peptide or protein comprising or consisting of a nucleocapsid protein (N) of a MERS coronavirus, or a fragment or variant thereof, wherein the at least one coding region comprises or consists of an RNA sequence according to any one of SEQ ID NO: 429 to 456, 581 to 608, 733 to 760, 885 to 912, 1037 to 1064, 1189 to 1216 or 1341 to 1368, or a fragment or variant of any one of these RNA sequences. Preferably, the at least one coding region comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 429 to 456, 581 to 608, 733 to 760, 885 to 912, 1037 to 1064, 1189 to 1216 or 1341 to 1368.

G/C Content Modification:

According to another embodiment, the mRNA of the present invention, may be modified, and thus stabilized, by modifying the guanosine/cytosine (G/C) content of the mRNA, preferably of the at least one coding region of the mRNA of the present invention.

In a particularly preferred embodiment of the present invention, the G/C content of the coding region of the mRNA of the present invention is modified, particularly increased, compared to the G/C content of the coding region of the respective wild type mRNA, i.e. the unmodified mRNA. The amino acid sequence encoded by the mRNA is preferably not modified as compared to the amino acid sequence encoded by the respective wild type mRNA. This modification of the mRNA sequence of the present invention is based on the fact that the sequence of any mRNA region to be translated is important for efficient translation of that mRNA. Thus, the composition of the mRNA and the sequence of various nucleotides are important. In particular, sequences having an increased G (guanosine)/C (cytosine) content are more stable than sequences having an increased A (adenosine)/U (uracil) content. According to the invention, the codons of the mRNA are therefore varied compared to the respective wild type mRNA, while retaining the translated amino acid sequence, such that they include an increased amount of G/C nucleotides. In respect to the fact that several codons code for one and the same amino acid (so-called degeneration of the genetic code), the most favourable codons for the stability can be determined (so-called alternative codon usage). Depending on the amino acid to be encoded by the mRNA, there are various possibilities for modification of the mRNA sequence, compared to its wild type sequence. In the case of amino acids, which are encoded by codons, which contain exclusively G or C nucleotides, no modification of the codon is necessary. Thus, the codons for Pro (CCC or CCG), Arg (CGC or CGG), Ala (GCC or GCG) and Gly (GGC or GGG) require no modification, since no A or U is present. In contrast, codons which contain A and/or U nucleotides can be modified by substitution of other codons, which code for the same amino acids but contain no A and/or U. Examples of these are: the codons for Pro can be modified from CCU or CCA to CCC or CCG; the codons for Arg can be modified from CGU or CGA or AGA or AGG to CGC or CGG; the codons for Ala can be modified from GCU or GCA to GCC or GCG; the codons for Gly can be modified from GGU or GGA to GGC or GGG. In other cases, although A or U nucleotides cannot be eliminated from the codons, it is however possible to decrease the A and U content by using codons which contain a lower content of A and/or U nucleotides. Examples of these are: the codons for Phe can be modified from UUU to UUC; the codons for Leu can be modified from UUA, UUG, CUU or CUA to CUC or CUG; the codons for Ser can be modified from UCU or UCA or AGU to UCC, UCG or AGC; the codon for Tyr can be modified from UAU to UAC; the codon for Cys can be modified from UGU to UGC; the codon for His can be modified from CAU to CAC; the codon for Gln can be modified from CM to CAG; the codons for Ile can be modified from AUU or AUA to AUC; the codons for Thr can be modified from ACU or ACA to ACC or ACG; the codon for Asn can be modified from MU to MC; the codon for Lys can be modified from AAA to MG; the codons for Val can be modified from GUU or GUA to GUC or GUG; the codon for Asp can be modified from GAU to GAC; the codon for Glu can be modified from GM to GAG; the stop codon UAA can be modified to UAG or UGA. In the case of the codons for Met (AUG) and Trp (UGG), on the other hand, there is no possibility of sequence modification. The substitutions listed above can be used either individually or in all possible combinations to increase the G/C content of the mRNA sequence of the present invention compared to its particular wild type mRNA (i.e. the original sequence). Thus, for example, all codons for Thr occurring in the wild type sequence can be modified to ACC (or ACG). Preferably, however, for example, combinations of the above substitution possibilities are used:

substitution of all codons coding for Thr in the original sequence (wild type mRNA) to ACC (or ACG) and substitution of all codons originally coding for Ser to UCC (or UCG or AGC); substitution of all codons coding for Ile in the original sequence to AUC and substitution of all codons originally coding for Lys to MG and substitution of all codons originally coding for Tyr to UAC; substitution of all codons coding for Val in the original sequence to GUC (or GUG) and substitution of all codons originally coding for Glu to GAG and substitution of all codons originally coding for Ala to GCC (or GCG) and substitution of all codons originally coding for Arg to CGC (or CGG); substitution of all codons coding for Val in the original sequence to GUC (or GUG) and
substitution of all codons originally coding for Glu to GAG and
substitution of all codons originally coding for Ala to GCC (or GCG) and
substitution of all codons originally coding for Gly to GGC (or GGG) and
substitution of all codons originally coding for Asn to MC;
substitution of all codons coding for Val in the original sequence to GUC (or GUG) and
substitution of all codons originally coding for Phe to UUC and
substitution of all codons originally coding for Cys to UGC and
substitution of all codons originally coding for Leu to CUG (or CUC) and
substitution of all codons originally coding for Gln to CAG and
substitution of all codons originally coding for Pro to CCC (or CCG); etc.

Preferably, the G/C content of the coding region of the mRNA sequence of the present invention is increased by at least 7%, more preferably by at least 15%, particularly preferably by at least 20%, compared to the G/C content of the coding region of the wild type RNA, which codes for an antigen as defined herein or a fragment or variant thereof. According to a specific embodiment at least 5%, 10%, 20%, 30%, 40%, 50%, 60%, more preferably at least 70%, even more preferably at least 80% and most preferably at least 90%, 95% or even 100% of the substitutable codons in the region coding for a peptide or protein as defined herein or a fragment or variant thereof or the whole sequence of the wild type mRNA sequence are substituted, thereby increasing the GC/content of said sequence. In this context, it is particularly preferable to increase the G/C content of the mRNA sequence of the present invention, preferably of the at least one coding region of the mRNA sequence according to the invention, to the maximum (i.e. 100% of the substitutable codons) as compared to the wild type sequence. According to the invention, a further preferred modification of the mRNA sequence of the present invention is based on the finding that the translation efficiency is also determined by a different frequency in the occurrence of tRNAs in cells. Thus, if so-called "rare codons" are present in the mRNA sequence of the present invention to an increased extent, the corresponding modified mRNA sequence is translated to a significantly poorer degree than in the case where codons coding for relatively "frequent" tRNAs are present. According to the invention, in the modified mRNA sequence of the present invention, the region which codes for a peptide or protein as defined herein or a fragment or variant thereof is modified compared to the corresponding region of the wild type mRNA sequence such that at least one codon of the wild type sequence, which codes for a tRNA which is relatively rare in the cell, is exchanged for a codon, which codes for a tRNA which is relatively frequent in the cell and carries the same amino acid as the relatively rare tRNA. By this modification, the sequence of the mRNA of the present invention is modified such that codons for which frequently occurring tRNAs are available are inserted. In other words, according to the invention, by this modification all codons of the wild type sequence, which code for a tRNA which is relatively rare in the cell, can in each case be exchanged for a codon, which codes for a tRNA which is relatively frequent in the cell and which, in each case, carries the same amino acid as the relatively rare tRNA. Which tRNAs occur relatively frequently in the cell and which, in contrast, occur relatively rarely is known to a person skilled in the art; cf. e.g. Akashi, Curr. Opin. Genet. Dev. 2001, 11(6): 660-666. The codons, which use for the particular amino acid the tRNA which occurs the most frequently, e.g. the Gly codon, which uses the tRNA, which occurs the most frequently in the (human) cell, are particularly preferred. According to the invention, it is particularly preferable to link the sequential G/C content which is increased, in particular maximized, in the modified mRNA sequence of the present invention, with the "frequent" codons without modifying the amino acid sequence of the protein encoded by the coding region of the mRNA sequence. This preferred embodiment allows provision of a particularly efficiently translated and stabilized (modified) mRNA sequence of the present invention. The determination of a modified mRNA sequence of the present invention as described above (increased G/C content; exchange of tRNAs) can be carried out using the computer program explained in WO02/098,443—the disclosure content of which is included in its full scope in the present invention. Using this computer program, the nucleotide sequence of any desired mRNA sequence can be modified with the aid of the genetic code or the degenerative nature thereof such that a maximum G/C content results, in combination with the use of codons which code for tRNAs occurring as frequently as possible in the cell, the amino acid sequence coded by the modified mRNA sequence preferably not being modified compared to the non-modified sequence. Alternatively, it is also possible to modify only the G/C content or only the codon usage compared to the original sequence. The source code in Visual Basic 6.0 (development environment used: Microsoft Visual Studio Enterprise 6.0 with Servicepack 3) is also described in WO02/098,443. In a further preferred embodiment of the present invention, the A/U content in the environment of the ribosome binding site of the mRNA sequence of the present invention is increased compared to the A/U content in the environment of the ribosome binding site of its respective wild type mRNA. This modification (an increased A/U content around the ribosome binding site) increases the efficiency of ribosome binding to the mRNA. An effective binding of the ribosomes to the ribosome binding site (Kozak sequence: SEQ ID NO: 213737; the AUG forms the start codon) in turn has the effect of an efficient translation of the mRNA. According to a further embodiment of the present invention, the mRNA sequence of the present invention may be modified with respect to potentially destabilizing sequence elements. Particularly, the coding region and/or the 5 and/or 3 untranslated region of this mRNA sequence may be modified compared to the respective wild type mRNA such that it contains no destabilizing sequence elements, the encoded amino acid sequence of the modified mRNA sequence preferably not being modified compared to its respective wild type mRNA. It is known that, for example in sequences of eukaryotic mRNAs, destabilizing sequence elements (DSE) occur, to which signal proteins bind and regulate enzymatic degradation of mRNA in vivo. For further stabilization of the modified mRNA sequence, optionally in the region which encodes at least one peptide or protein as defined herein or a fragment or variant thereof, one or more such modifications compared to the corresponding region of the wild type mRNA can therefore be carried out, so that no or substantially no destabilizing sequence elements are contained there. According to the invention, DSE present in the untranslated regions (3 and/or 5-UTR) can also be eliminated from the mRNA sequence of the present invention by such modifications. Such destabilizing sequences are e.g. AU-rich sequences (AURES), which occur in 3'-UTR sections of numerous unstable mRNAs (Caput et al., Proc. Natl. Acad. Sci. USA 1986, 83: 1670 to 1674). The mRNA sequence of the present invention is therefore preferably modified compared to the respective wild type mRNA such that the mRNA sequence of the present invention contains no such destabilizing sequences. This also applies to those sequence motifs which are recognized by possible endonucleases, e.g. the sequence GAACAAG, which is contained in the 3'-UTR segment of the gene encoding the transferrin receptor (Binder et al., EMBO J. 1994, 13: 1969 to 1980). These sequence motifs are also preferably removed in the mRNA sequence of the present invention.

In preferred embodiments, the mRNA according to the invention comprises at least one coding region encoding at least one antigenic peptide or protein comprising or consisting of a spike protein (S or S_stabilized), a spike 51 fragment (S1), an envelope protein (E), a membrane protein (M) or a nucleocapsid protein (N) of a MERS coronavirus, or a fragment or variant of any one of these proteins, wherein the mRNA, preferably the at least one coding region, comprises or consists of a (modified) nucleic acid sequence selected from SEQ ID NO: 305-456 or 1650-1750 or 2366 or 913-1368 or 2054-2154, or a fragment or variant of any one of these nucleic acid sequences. Preferably, the at least one coding region comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 305-456 or 1650-1750 or 2366 or 913-1368 or 2054-2154.

According to a preferred embodiment, the at least one coding region of the inventive mRNA encodes an antigenic peptide or protein comprising or consisting of a spike protein (S or S_stabilized) of a MERS coronavirus, or a fragment or variant thereof, wherein the at least one coding region comprises or consists of an RNA sequence according to any one of SEQ ID NO: 305-253 or 2365, 913-1013, 1065-1165 or 1217-1317, or a fragment or variant of any one of these RNA sequences. Preferably, the at least one coding region comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 305-253 or 2365, 913-1013, 1065-1165 or 1217-1317.

According to a preferred embodiment, the at least one coding region of the inventive mRNA encodes an antigenic peptide or protein comprising or consisting of a 51 subunit of a spike protein (51) of a MERS coronavirus, or a fragment or variant thereof, wherein the at least one coding region comprises or consists of an RNA sequence according to any one of SEQ ID NO: 1650 to 1750 or 2366, 2054 to 2154, 2155 to 2255, 2256 to 2356, or a fragment or variant of any one of these RNA sequences. Preferably, the at least one coding region comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 1650 to 1750 or 2366, 2054 to 2154, 2155 to 2255, 2256 to 2356.

It is further preferred that the at least one coding region of the inventive mRNA encodes an antigenic peptide or protein comprising or consisting of an envelope protein (E) of a MERS coronavirus, or a fragment or variant thereof, wherein the at least one coding region comprises or consists of an RNA sequence according to any one of SEQ ID NO: 406-412, 1014-1020, 1166-1172 or 1318-1324, or a fragment or variant of any one of these RNA sequences. More preferably, the at least one coding region comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 406-412, 1014-1020, 1166-1172 or 1318-1324.

According to some embodiments, the at least one coding region of the inventive mRNA encodes an antigenic peptide or protein comprising or consisting of a membrane protein (M) of a MERS coronavirus, or a fragment or variant thereof, wherein the at least one coding region comprises or consists of an RNA sequence according to any one of SEQ ID NO: 413-428, 1021-1036, 1173-1188 or 1325-1340, or a fragment or variant of any one of these RNA sequences. Preferably, the at least one coding region comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 413-428, 1021-1036, 1173-1188 or 1325-1340.

It is further preferred that the at least one coding region of the inventive mRNA encodes an antigenic peptide or protein comprising or consisting of a nucleocapsid protein (N) of a MERS coronavirus, or a fragment or variant thereof, wherein the at least one coding region comprises or consists of an RNA sequence according to any one of SEQ ID NO: 429-456, 1037-1064, 1189-1216 or 1341-1368, or a fragment or variant of any one of these RNA sequences. Preferably, the at least one coding region comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 429-456, 1037-1064, 1189-1216 or 1341-1368.

Sequences Adapted to Human Codon Usage:

According to the invention, a further preferred modification of the mRNA sequence of the present invention is based on the finding that codons encoding the same amino acid typically occur at different frequencies. According to the invention, in the modified mRNA sequence of the present invention, the coding region as defined herein is preferably modified compared to the corresponding coding region of the respective wild type mRNA such that the frequency of the codons encoding the same amino acid corresponds to the naturally occurring frequency of that codon according to the human codon usage as e.g. shown in Table 5.

For example, in the case of the amino acid alanine (Ala) present in an amino acid sequence encoded by the at least one coding region of the mRNA sequence according to the invention, the wild type coding region is preferably adapted in a way that the codon "GCC" is used with a frequency of 0.40, the codon "GCT" is used with a frequency of 0.28, the codon "GCA" is used with a frequency of 0.22 and the codon "GCG" is used with a frequency of 0.10 etc. (see Table 5).

TABLE 5

Human codon usage table

| Amino acid | codon | fraction | /1000 |
|---|---|---|---|
| Ala | GCG | 0.10 | 7.4 |
| Ala | GCA | 0.22 | 15.8 |
| Ala | GCT | 0.28 | 18.5 |
| Ala | GCC* | 0.40 | 27.7 |
| Cys | TGT | 0.42 | 10.6 |
| Cys | TGC* | 0.58 | 12.6 |
| Asp | GAT | 0.44 | 21.8 |
| Asp | GAC* | 0.56 | 25.1 |
| Glu | GAG* | 0.59 | 39.6 |
| Glu | GAA | 0.41 | 29.0 |
| Phe | TTT | 0.43 | 17.6 |
| Phe | TTC* | 0.57 | 20.3 |
| Gly | GGG | 0.23 | 16.5 |
| Gly | GGA | 0.26 | 16.5 |
| Gly | GGT | 0.18 | 10.8 |
| Gly | GGC* | 0.33 | 22.2 |
| His | CAT | 0.41 | 10.9 |
| His | CAC* | 0.59 | 15.1 |
| Ile | ATA | 0.14 | 7.5 |
| Ile | ATT | 0.35 | 16.0 |
| Ile | ATC* | 0.52 | 20.8 |
| Lys | AAG* | 0.60 | 31.9 |
| Lys | AAA | 0.40 | 24.4 |
| Leu | TTG | 0.12 | 12.9 |
| Leu | TTA | 0.06 | 7.7 |
| Leu | CTG* | 0.43 | 39.6 |
| Leu | CTA | 0.07 | 7.2 |
| Leu | CTT | 0.12 | 13.2 |
| Leu | CTC | 0.20 | 19.6 |
| Met | ATG* | 1 | 22.0 |
| Asn | AAT | 0.44 | 17.0 |
| Asn | AAC* | 0.56 | 19.1 |
| Pro | CCG | 0.11 | 6.9 |
| Pro | CCA | 0.27 | 16.9 |
| Pro | CCT | 0.29 | 17.5 |
| Pro | CCC* | 0.33 | 19.8 |
| Gln | CAG* | 0.73 | 34.2 |
| Gln | CAA | 0.27 | 12.3 |
| Arg | AGG | 0.22 | 12.0 |
| Arg | AGA* | 0.21 | 12.1 |
| Arg | CGG | 0.19 | 11.4 |
| Arg | CGA | 0.10 | 6.2 |
| Arg | CGT | 0.09 | 4.5 |
| Arg | CGC | 0.19 | 10.4 |
| Ser | AGT | 0.14 | 12.1 |
| Ser | AGC* | 0.25 | 19.5 |
| Ser | TCG | 0.06 | 4.4 |
| Ser | TCA | 0.15 | 12.2 |
| Ser | TCT | 0.18 | 15.2 |
| Ser | TCC | 0.23 | 17.7 |
| Thr | ACG | 0.12 | 6.1 |
| Thr | ACA | 0.27 | 15.1 |
| Thr | ACT | 0.23 | 13.1 |
| Thr | ACC* | 0.38 | 18.9 |
| Val | GTG* | 0.48 | 28.1 |
| Val | GTA | 0.10 | 7.1 |

TABLE 5-continued

Human codon usage table

| Amino acid | codon | fraction | /1000 |
|---|---|---|---|
| Val | GTT | 0.17 | 11.0 |
| Val | GTC | 0.25 | 14.5 |
| Trp | TGG* | 1 | 13.2 |
| Tyr | TAT | 0.42 | 12.2 |
| Tyr | TAC* | 0.58 | 15.3 |
| Stop | TGA* | 0.61 | 1.6 |
| Stop | TAG | 0.17 | 0.8 |
| Stop | TAA | 0.22 | 1.0 |

*most frequent codon

In preferred embodiments, the mRNA according to the invention comprises at least one coding region encoding at least one antigenic peptide or protein comprising or consisting of a spike protein or S_stabilized), a S1 subunit of a spike protein (S1), an envelope protein (E), a membrane protein (M) or a nucleocapsid protein (N) of a MERS coronavirus, or a fragment or variant of any one of these proteins, wherein the mRNA, preferably the at least one coding region, comprises or consists of a (modified) nucleic acid sequence selected from SEQ ID NO: 609-760 or 1852-1952 or a nucleid acid sequence listed in column 4 of Tables 1-4 and 7, or a fragment or variant of any one of these nucleic acid sequences. Preferably, the at least one coding region comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 609-760 or 1852-1952 or with any one of the nucleic acid sequences listed in column 4 of Tables 1-4 and 7.

According to a preferred embodiment, the at least one coding region of the inventive mRNA encodes an antigenic peptide or protein comprising or consisting of a spike protein (S or S_stabilized) of a MERS coronavirus, or a fragment or variant thereof, wherein the at least one coding region comprises or consists of an RNA sequence according to any one of SEQ ID NO: 609-709, or a fragment or variant of any one of these RNA sequences. Preferably, the at least one coding region comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 609-709.

According to a preferred embodiment, the at least one coding region of the inventive mRNA encodes an antigenic peptide or protein comprising or consisting of a 51 subunit of a spike protein (S1) of a MERS coronavirus, or a fragment or variant thereof, wherein the at least one coding region comprises or consists of an RNA sequence according to any one of SEQ ID NO: 1852-1952, or a fragment or variant of any one of these RNA sequences. Preferably, the at least one coding region comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 1852-1952.

It is further preferred that the at least one coding region of the inventive mRNA encodes an antigenic peptide or protein comprising or consisting of envelope protein (E) of a MERS coronavirus, or a fragment or variant thereof, wherein the at least one coding region comprises or consists of an RNA sequence according to any one of SEQ ID NO: 710 to 716, or a fragment or variant of any one of these RNA sequences. More preferably, the at least one coding region comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 710 to 716.

According to some embodiments, the at least one coding region of the inventive mRNA encodes an antigenic peptide or protein comprising or consisting of a membrane protein (M) of a MERS coronavirus, or a fragment or variant thereof, wherein the at least one coding region comprises or consists of an RNA sequence according to any one of SEQ ID NO: 717 to 732, or a fragment or variant of any one of these RNA sequences. Preferably, the at least one coding region comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 717 to 732.

It is further preferred that the at least one coding region of the inventive mRNA encodes an antigenic peptide or protein comprising or consisting of a nucleocapsid protein (N) of a MERS coronavirus, or a fragment or variant thereof, wherein the at least one coding region comprises or consists of an RNA sequence according to any one of SEQ ID NO: 733 to 760, or a fragment or variant of any one of these RNA sequences. Preferably, the at least one coding region comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 733 to 760.

Codon-Optimized Sequences:

As described above it is preferred according to the invention, that all codons of the wild type sequence which code for a tRNA, which is relatively rare in the cell, are exchanged for a codon which codes for a tRNA, which is relatively frequent in the cell and which, in each case, carries the same amino acid as the relatively rare tRNA. Therefore it is particularly preferred that the most frequent codons are used for each encoded amino acid (see Table 5, most frequent codons are marked with asterisks). Such an optimization procedure increases the codon adaptation index (CAI) and ultimately maximises the CAI. In the context of the invention, sequences with increased or maximized CAI are typically referred to as "codon-optimized" sequences and/or CAI increased and/or maximized sequences. According to a preferred embodiment, the mRNA sequence of the present invention comprises at least one coding region, wherein the coding region/sequence is codon-optimized as described herein. More preferably, the codon adaptation index (CAI) of the at least one coding sequence is at least 0.5, at least 0.8, at least 0.9 or at least 0.95. Most preferably, the codon adaptation index (CAI) of the at least one coding sequence is 1.

For example, in the case of the amino acid alanine (Ala) present in the amino acid sequence encoded by the at least one coding sequence of the RNA according to the invention, the wild type coding sequence is adapted in a way that the most frequent human codon "GCC" is always used for said amino acid, or for the amino acid Cysteine (Cys), the wild type sequence is adapted in a way that the most frequent human codon "TGC" is always used for said amino acid etc.

In preferred embodiments, the mRNA according to the invention comprises at least one coding region encoding at least one antigenic peptide or protein comprising or consisting of a spike protein (S or S_stabilized), a S1 subunit of a spike protein (S1), an envelope protein (E), a membrane protein (M) or a nucleocapsid protein (N) of a MERS coronavirus, or a fragment or variant of any one of these proteins, wherein the mRNA, preferably the at least one coding region, comprises or consists of a (modified) nucleic acid sequence selected from SEQ ID NO: 761-912 or 1953-2053 or a nucleid acid sequence listed in column 4 of Tables 1-4 and 7, or a fragment or variant of any one of these nucleic acid sequences. Preferably, the at least one coding region comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 761-912 or 1953-2053 or with any one of the nucleic acid sequences listed in column 4 of Tables 1-4 and 7.

According to a preferred embodiment, the at least one coding region of the inventive mRNA encodes an antigenic peptide or protein comprising or consisting of a spike protein (S or S_stabilized) of a MERS coronavirus, or a fragment or variant thereof, wherein the at least one coding region comprises or consists of an RNA sequence according to any one of SEQ ID NO: 761 to 861, or a fragment or variant of any one of these RNA sequences. Preferably, the at least one coding region comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 761 to 861.

According to a preferred embodiment, the at least one coding region of the inventive mRNA encodes an antigenic peptide or protein comprising or consisting of a S1 subunit of a spike protein (S1) of a MERS coronavirus, or a fragment or variant thereof, wherein the at least one coding region comprises or consists of an RNA sequence according to any one of SEQ ID NO: 1953-2053, or a fragment or variant of any one of these RNA sequences. Preferably, the at least one coding region comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 1953-2053.

It is further preferred that the at least one coding region of the inventive mRNA encodes an antigenic peptide or protein comprising or consisting of envelope protein (E) of a MERS coronavirus, or a fragment or variant thereof, wherein the at least one coding region comprises or consists of an RNA sequence according to any one of SEQ ID NO: 862 to 868, or a fragment or variant of any one of these RNA sequences. More preferably, the at least one coding region comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 862 to 868.

According to some embodiments, the at least one coding region of the inventive mRNA encodes an antigenic peptide or protein comprising or consisting of a membrane protein (M) of a MERS coronavirus, or a fragment or variant thereof, wherein the at least one coding region comprises or consists of an RNA sequence according to any one of SEQ ID NO: 869 to 884, or a fragment or variant of any one of these RNA sequences. Preferably, the at least one coding region comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 869 to 884.

It is further preferred that the at least one coding region of the inventive mRNA encodes an antigenic peptide or protein comprising or consisting of a nucleocapsid protein (N) of a MERS coronavirus, or a fragment or variant thereof, wherein the at least one coding region comprises or consists of an RNA sequence according to any one of SEQ ID NO: 885 to 912, or a fragment or variant of any one of these RNA sequences. Preferably, the at least one coding region comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 885 to 912.

5'-Cap Structure

According to another preferred embodiment of the invention, a modified mRNA as defined herein, can be modified by the addition of a so-called "5'-cap" structure, which preferably stabilizes the mRNA as described herein. A 5'-cap is an entity, typically a modified nucleotide entity, which generally "caps" the 5'-end of a mature mRNA. A 5'-cap may typically be formed by a modified nucleotide, particularly by a derivative of a guanine nucleotide. Preferably, the 5'-cap is linked to the 5'-terminus via a 5'-5'-triphosphate linkage. A 5'-cap may be methylated, e.g. m7GpppN, wherein N is the terminal 5' nucleotide of the nucleic acid carrying the 5'-cap, typically the 5'-end of an mRNA. m7GpppN is the 5'-cap structure, which naturally occurs in mRNA transcribed by polymerase II and is therefore preferably not considered as modification comprised in a modified mRNA in this context. Accordingly, a modified mRNA sequence of the present invention may comprise a m7GpppN as 5'-cap, but additionally the modified mRNA sequence typically comprises at least one further modification as defined herein.

Further examples of 5'-cap structures include glyceryl, inverted deoxy abasic residue (moiety), 4',5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5 dihydroxypentyl nucleotide, 3'-3'-inverted nucleotide moiety, 3'-3'-inverted abasic moiety, 3'-2'-inverted nucleotide moiety, 3'-2'-inverted abasic moiety, 1,4-butanediol phosphate, 3'-phosphoramidate, hexylphosphate, aminohexyl phosphate, 3'-phosphate, 3' phosphorothioate, phosphorodithioate, or bridging or non-bridging methylphosphonate moiety. These modified 5'-cap structures are regarded as at least one modification in this context.

Particularly preferred modified 5'-cap structures are cap1 (methylation of the ribose of the adjacent nucleotide of m7G), cap2 (additional methylation of the ribose of the 2nd nucleotide downstream of the m7G), cap3 (additional methylation of the ribose of the 3rd nucleotide downstream of the m7G), cap4 (methylation of the ribose of the 4th nucleotide downstream of the m7G), ARCA (anti-reverse cap analogue, modified ARCA (e.g. phosphothioate modified ARCA), inosine, N1-methyl-guanosine, 2'-fluoro-guanosine, 7-deaza-guanosine, 8-oxo-guanosine, 2-amino-guanosine, LNA-guanosine, and 2-azido-guanosine. Accordingly, the RNA according to the invention preferably comprises a 5'-cap structure.

C-Optimized Sequences:

According to another embodiment, the mRNA sequence of the present invention may be modified by modifying, preferably increasing, the cytosine (C) content of the mRNA sequence, preferably of the coding region of the mRNA sequence.

In a particularly preferred embodiment of the present invention, the C content of the coding region of the mRNA sequence of the present invention is modified, preferably increased, compared to the C content of the coding region of the respective wild type mRNA, i.e. the unmodified mRNA. The amino acid sequence encoded by the at least one coding region of the mRNA sequence of the present invention is preferably not modified as compared to the amino acid sequence encoded by the respective wild type mRNA.

In a preferred embodiment of the present invention, the modified mRNA sequence is modified such that at least 10%, 20%, 30%, 40%, 50%, 60%, 70% or 80%, or at least 90% of the theoretically possible maximum cytosine-content or even a maximum cytosine-content is achieved.

In further preferred embodiments, at least 10%, 20%, 30%, 40%, 50%, 60%, 70%, 80%, 90% or even 100% of the codons of the target mRNA wild type sequence, which are "cytosine content optimizable" are replaced by codons having a higher cytosine-content than the ones present in the wild type sequence.

In a further preferred embodiment, some of the codons of the wild type coding sequence may additionally be modified such that a codon for a relatively rare tRNA in the cell is exchanged by a codon for a relatively frequent tRNA in the cell, provided that the substituted codon for a relatively frequent tRNA carries the same amino acid as the relatively rare tRNA of the original wild type codon. Preferably, all of the codons for a relatively rare tRNA are replaced by a codon for a relatively frequent tRNA in the cell, except codons encoding amino acids, which are exclusively encoded by codons not containing any cytosine, or except for glutamine (Gln), which is encoded by two codons each containing the same number of cytosines.

In a further preferred embodiment of the present invention, the modified target mRNA is modified such that at least 80%, or at least 90% of the theoretically possible maximum cytosine-content or even a maximum cytosine-content is achieved by means of codons, which code for relatively frequent tRNAs in the cell, wherein the amino acid sequence remains unchanged.

Due to the naturally occurring degeneracy of the genetic code, more than one codon may encode a particular amino acid. Accordingly, 18 out of 20 naturally occurring amino acids are encoded by more than one codon (with Tryp and Met being an exception), e.g. by 2 codons (e.g. Cys, Asp, Glu), by three codons (e.g. Ile), by 4 codons (e.g. Al, Gly, Pro) or by 6 codons (e.g. Leu, Arg, Ser). However, not all codons encoding the same amino acid are utilized with the same frequency under in vivo conditions. Depending on each single organism, a typical codon usage profile is established.

The term "cytosine content-optimizable codon" as used within the context of the present invention refers to codons, which exhibit a lower content of cytosines than other codons encoding the same amino acid. Accordingly, any wild type codon, which may be replaced by another codon encoding the same amino acid and exhibiting a higher number of cytosines within that codon, is considered to be cytosine-optimizable (C-optimizable). Any such substitution of a C-optimizable wild type codon by the specific C-optimized codon within a wild type coding region increases its overall C-content and reflects a C-enriched modified mRNA sequence. According to a preferred embodiment, the mRNA sequence of the present invention, preferably the at least one coding region of the mRNA sequence of the present invention comprises or consists of a C-maximized mRNA sequence containing C-optimized codons for all potentially C-optimizable codons. Accordingly, 100% or all of the theoretically replaceable C-optimizable codons are preferably replaced by C-optimized codons over the entire length of the coding region.

In this context, cytosine-content optimizable codons are codons, which contain a lower number of cytosines than other codons coding for the same amino acid.

Any of the codons GCG, GCA, GCU codes for the amino acid Ala, which may be exchanged by the codon GCC encoding the same amino acid, and/or
the codon UGU that codes for Cys may be exchanged by the codon UGC encoding the same amino acid, and/or
the codon GAU which codes for Asp may be exchanged by the codon GAC encoding the same amino acid, and/or
the codon that UUU that codes for Phe may be exchanged for the codon UUC encoding the same amino acid, and/or any of the codons GGG, GGA, GGU that code Gly may be exchanged by the codon GGC encoding the same amino acid, and/or
the codon CAU that codes for His may be exchanged by the codon CAC encoding the same amino acid, and/or
any of the codons AUA, AUU that code for Ile may be exchanged by the codon AUC, and/or
any of the codons UUG, UUA, CUG, CUA, CUU coding for Leu may be exchanged by the codon CUC encoding the same amino acid, and/or
the codon MU that codes for Asn may be exchanged by the codon MC encoding the same amino acid, and/or
any of the codons CCG, CCA, CCU coding for Pro may be exchanged by the codon CCC encoding the same amino acid, and/or
any of the codons AGG, AGA, CGG, CGA, CGU coding for Arg may be exchanged by the codon CGC encoding the same amino acid, and/or
any of the codons AGU, AGC, UCG, UCA, UCU coding for Ser may be exchanged by the codon UCC encoding the same amino acid, and/or
any of the codons ACG, ACA, ACU coding for Thr may be exchanged by the codon ACC encoding the same amino acid, and/or
any of the codons GUG, GUA, GUU coding for Val may be exchanged by the codon GUC encoding the same amino acid, and/or
the codon UAU coding for Tyr may be exchanged by the codon UAC encoding the same amino acid.

In any of the above instances, the number of cytosines is increased by 1 per exchanged codon. Exchange of all non C-optimized codons (corresponding to C-optimizable codons) of the coding region results in a C-maximized coding sequence. In the context of the invention, at least 70%, preferably at least 80%, more preferably at least 90%, of the non C-optimized codons within the at least one coding region of the mRNA sequence according to the invention are replaced by C-optimized codons.

It may be preferred that for some amino acids the percentage of C-optimizable codons replaced by C-optimized codons is less than 70%, while for other amino acids the percentage of replaced codons is higher than 70% to meet the overall percentage of C-optimization of at least 70% of all C-optimizable wild type codons of the coding region.

Preferably, in a C-optimized mRNA sequence of the invention, at least 50% of the C-optimizable wild type codons for any given amino acid are replaced by C-optimized codons, e.g. any modified C-enriched mRNA sequence preferably contains at least 50% C-optimized codons at C-optimizable wild type codon positions encoding any one of the above mentioned amino acids Ala, Cys, Asp, Phe, Gly, His, Ile, Leu, Asn, Pro, Arg, Ser, Thr, Val and Tyr, preferably at least 60%.

In this context codons encoding amino acids, which are not cytosine content-optimizable and which are, however, encoded by at least two codons, may be used without any further selection process. However, the codon of the wild type sequence that codes for a relatively rare tRNA in the cell, e.g. a human cell, may be exchanged for a codon that codes for a relatively frequent tRNA in the cell, wherein both code for the same amino acid. Accordingly, the relatively rare codon GM coding for Glu may be exchanged by the relative frequent codon GAG coding for the same amino acid, and/or
the relatively rare codon AAA coding for Lys may be exchanged by the relative frequent codon MG coding for the same amino acid, and/or the relatively rare codon CAA coding for Gln may be exchanged for the relative frequent codon CAG encoding the same amino acid.

In this context, the amino acids Met (AUG) and Trp (UGG), which are encoded by only one codon each, remain unchanged. Stop codons are not cytosine-content optimized, however, the relatively rare stop codons amber, ochre (UM, UAG) may be exchanged by the relatively frequent stop codon opal (UGA).

The single substitutions listed above may be used individually as well as in all possible combinations in order to optimize the cytosine-content of the modified mRNA sequence compared to the wild type mRNA sequence.

Accordingly, the at least one coding sequence as defined herein may be changed compared to the coding region of the respective wild type mRNA in such a way that an amino acid encoded by at least two or more codons, of which one comprises one additional cytosine, such a codon may be exchanged by the C-optimized codon comprising one additional cytosine, wherein the amino acid is preferably unaltered compared to the wild type sequence.

In preferred embodiments, the mRNA according to the invention comprises at least one coding region encoding at least one antigenic peptide or protein comprising or consisting of a spike protein (S or S_stabilized), a S1 subunit of a spike protein (S1), an envelope protein (E), a membrane protein (M) or a nucleocapsid protein (N) of a MERS coronavirus, or a fragment or variant of any one of these proteins, wherein the mRNA, preferably the at least one coding region, comprises or consists of a (modified) nucleic acid sequence selected from SEQ ID NO: 457-608 or 1751-1851 or a nucleid acid sequence listed in column 4 of Tables 1-4 and 7, or a fragment or variant of any one of these nucleic acid sequences. Preferably, the at least one coding region comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 457-608 or 1751-1851 or with any one of the nucleic acid sequences listed in column 4 of Tables 1-4 and 7.

According to a preferred embodiment, the at least one coding region of the inventive mRNA encodes an antigenic peptide or protein comprising or consisting of a spike protein (S or S_stabilized) of a MERS coronavirus, or a fragment or variant thereof, wherein the at least one coding region comprises or consists of an RNA sequence according to any one of SEQ ID NO: 457 to 557, or a fragment or variant of any one of these RNA sequences. Preferably, the at least one coding region comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 457 to 557.

According to a preferred embodiment, the at least one coding region of the inventive mRNA encodes an antigenic peptide or protein comprising or consisting of a S1 subunit of a spike protein (S1) of a MERS coronavirus, or a fragment or variant thereof, wherein the at least one coding region comprises or consists of an RNA sequence according to any one of SEQ ID NO: or 1751 to 1851, or a fragment or variant of any one of these RNA sequences. Preferably, the at least one coding region comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: or 1751 to 1851.

It is further preferred that the at least one coding region of the inventive mRNA encodes an antigenic peptide or protein comprising or consisting of an envelope protein (E) of a MERS coronavirus, or a fragment or variant thereof, wherein the at least one coding region comprises or consists of an RNA sequence according to any one of SEQ ID NO: 558 to 564, or a fragment or variant of any one of these RNA sequences. More preferably, the at least one coding region comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 558 to 564.

According to some embodiments, the at least one coding region of the inventive mRNA encodes an antigenic peptide or protein comprising or consisting of a membrane protein (M) of a MERS coronavirus, or a fragment or variant thereof, wherein the at least one coding region comprises or consists of an RNA sequence according to any one of SEQ ID NO: 565 to 580, or a fragment or variant of any one of these RNA sequences. Preferably, the at least one coding region comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 565 to 580.

It is further preferred that the at least one coding region of the inventive mRNA encodes an antigenic peptide or protein comprising or consisting of a nucleocapsid protein (N) of a MERS coronavirus, or a fragment or variant thereof, wherein the at least one coding region comprises or consists of an RNA sequence according to any one of SEQ ID NO: 581 to 608, or a fragment or variant of any one of these RNA sequences. Preferably, the at least one coding region comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NO: 581 to 608.

According to a particularly preferred embodiment, the invention provides an mRNA sequence, comprising at least one coding region as defined herein, wherein the G/C content of the at least one coding region of the mRNA sequence is increased compared to the G/C content of the corresponding coding region of the corresponding wild type mRNA, and/or wherein the C content of the at least one coding region of the mRNA sequence is increased compared to the C content of the corresponding coding region of the corresponding wild type mRNA, and/or wherein the codons in the at least one coding region of the mRNA sequence are adapted to human codon usage, wherein the codon adaptation index (CAI) is preferably increased or maximised in the at least one coding region of the mRNA sequence, and wherein the amino acid sequence encoded by the mRNA sequence is preferably not being modified compared to the amino acid sequence encoded by the corresponding wild type mRNA.

Poly(A) Sequence/Tail:

According to a further preferred embodiment, the mRNA of the present invention may contain a poly-A tail on the 3'-terminus of typically about 10 to 200 adenosine nucleotides, preferably about 10 to 100 adenosine nucleotides, more preferably about 40 to 80 adenosine nucleotides or even more preferably about 50 to 70 adenosine nucleotides.

In some embodiments, the poly(A) sequence comprises a sequence of about 25 to about 400 adenosine nucleotides, preferably a sequence of about 50 to about 400 adenosine nucleotides, more preferably a sequence of about 50 to about 300 adenosine nucleotides, even more preferably a sequence of about 50 to about 250 adenosine nucleotides, most preferably a sequence of about 60 to about 250 adenosine nucleotides.

Preferably, the poly(A) sequence in the mRNA of the present invention is derived from a DNA template by RNA in vitro transcription. Alternatively, the poly(A) sequence may also be obtained in vitro by common methods of chemical-synthesis without being necessarily transcribed from a DNA-progenitor. Moreover, poly(A) sequences, or poly(A) tails may be generated by enzymatic polyadenylation of the RNA according to the present invention using commercially available polyadenylation kits and corresponding protocols known in the art.

Alternatively, the mRNA as described herein optionally comprises a polyadenylation signal, which is defined herein as a signal, which conveys polyadenylation to a (transcribed) RNA by specific protein factors (e.g. cleavage and polyadenylation specificity factor (CPSF), cleavage stimulation factor (CstF), cleavage factors I and II (CF I and CF II), poly(A) polymerase (PAP)). In this context, a consensus polyadenylation signal is preferred comprising the NN(U/T)ANA consensus sequence. In a particularly preferred aspect, the polyadenylation signal comprises one of the following sequences: AA(U/T)AAA or A(U/T)(U/T)AAA (wherein uridine is usually present in RNA and thymidine is usually present in DNA).

Poly(C) Sequence:

According to a further preferred embodiment, the mRNA of the present invention may contain a poly(C) tail on the 3'-terminus of typically about 10 to 200 cytosine nucleotides, preferably about 10 to 100 cytosine nucleotides, more preferably about 20 to 70 cytosine nucleotides or even more preferably about 20 to 60 or even 10 to 40 cytosine nucleotides.

In some embodiments, the mRNA according to the invention comprises a 5'-cap structure as described herein, a poly(A) sequence, and, optionally, a poly(C) sequence.

In a preferred embodiment the mRNA comprises, preferably in 5'- to 3'-direction:

a.) a 5'-cap structure, preferably m7GpppN;

b.) at least one coding region encoding at least one antigenic peptide or protein comprising or consisting of a protein of MERS coronavirus, or a fragment or variant thereof, c.) optionally, a poly(A) sequence, preferably comprising 64 adenosines;

d.) optionally, a poly(C) sequence, preferably comprising 30 cytosines; and

In a particularly preferred embodiment the mRNA comprises, preferably in 5'- to 3'-direction:

a.) a 5'-cap structure, preferably m7GpppN;

b.) at least one coding region encoding at least one antigenic peptide or protein comprising or consisting of a protein of a MERS coronavirus, or a fragment or variant thereof, preferably comprising or consisting of any one of the nucleic acid sequences defined in column 3 ("B"; SEQ ID NO: 153-304) or column 4 ('C'; SEQ ID NO: 305-1368) of Tables 1-4, or a fragment or variant of any one of these nucleic acid sequences, c.) optionally, a poly(A) sequence, preferably comprising 64 adenosines;

d.) optionally, a poly(C) sequence, preferably comprising 30 cytosines; and

UTRs:

In a preferred embodiment, the mRNA according to the invention comprises at least one 5'- or 3'-UTR element. In this context, an UTR element comprises or consists of a nucleic acid sequence, which is derived from the 5'- or 3'-UTR of any naturally occurring gene or which is derived from a fragment, a homolog or a variant of the 5'- or 3'-UTR of a gene. Preferably, the 5'- or 3'-UTR element used according to the present invention is heterologous to the at least one coding region of the mRNA of the invention. Even if 5'- or 3'-UTR elements derived from naturally occurring genes are preferred, also synthetically engineered UTR elements may be used in the context of the present invention.

3'-UTR Elements

The term "3'-UTR element" typically refers to a nucleic acid sequence, which comprises or consists of a nucleic acid sequence that is derived from a 3'-UTR or from a variant of a 3'-UTR. A 3'-UTR element in the sense of the present invention may represent the 3'-UTR of an RNA, preferably an mRNA. Thus, in the sense of the present invention, preferably, a 3'-UTR element may be the 3'-UTR of an RNA, preferably of an mRNA, or it may be the transcription template for a 3'-UTR of an RNA. Thus, a 3'-UTR element preferably is a nucleic acid sequence which corresponds to the 3'-UTR of an RNA, preferably to the 3'-UTR of an mRNA, such as an mRNA obtained by transcription of a genetically engineered vector construct. Preferably, the 3'-UTR element fulfils the function of a 3'-UTR or encodes a sequence, which fulfils the function of a 3'-UTR.

Preferably, the at least one 3'-UTR element comprises or consists of a nucleic acid sequence derived from the 3'-UTR of a chordate gene, preferably a vertebrate gene, more preferably a mammalian gene, most preferably a human gene, or from a variant of the 3'-UTR of a chordate gene, preferably a vertebrate gene, more preferably a mammalian gene, most preferably a human gene.

Preferably, the mRNA of the present invention comprises a 3'-UTR element, which may be derivable from a gene that relates to an mRNA with an enhanced half-life (that provides a stable mRNA), for example a 3'-UTR element as defined and described below. Preferably, the 3'-UTR element is a nucleic acid sequence derived from a 3'-UTR of a gene, which preferably encodes a stable mRNA, or from a homolog, a fragment or a variant of said gene In a particularly preferred embodiment, the 3'-UTR element comprises or consists of a nucleic acid sequence, which is derived from a 3'-UTR of a gene selected from the group consisting of an albumin gene, an α-globin gene, a β-globin gene, a tyrosine hydroxylase gene, a lipoxygenase gene, and a collagen alpha gene, such as a collagen alpha 1(I) gene, or from a variant of a 3'-UTR of a gene selected from the group consisting of an albumin gene, an α-globin gene, a β-globin gene, a tyrosine hydroxylase gene, a lipoxygenase gene, and a collagen alpha gene, such as a collagen alpha 1(I) gene according to SEQ ID NO: 1369-1390 of the patent application WO2013/143,700, whose disclosure is incorporated herein by reference, or from a homolog, a fragment or a variant thereof. In a particularly preferred embodiment, the 3'-UTR element comprises or consists of a nucleic acid sequence which is derived from a 3'-UTR of an albumin gene, preferably a vertebrate albumin gene, more preferably a mammalian albumin gene, most preferably a human albumin gene according to SEQ ID NO: 1381 or the corresponding RNA sequences SEQ ID NO: 1382.

In this context it is particularly preferred that the mRNA according to the invention comprises a 3'-UTR element comprising a corresponding RNA sequence derived from the nucleic acids according to SEQ ID NO: 1369-1390 of the patent application WO2013/143,700 or a fragment, homolog or variant thereof.

Most preferably the 3'-UTR element comprises the nucleic acid sequence derived from a fragment of the human albumin gene according to SEQ ID NO: 1383 or 1385.

```
albumin7 3'-UTR
CATCACATTTAAAAGCATCTCAGCCTACCATGAGAATAAGAGAAAGAAAA

TGAAGATCAATAGCTTATTCATCTTTTTCTTTTTCGTTGGTGTAAAGCCA

ACACCCTGTCTAAAAAACATAAATTTCTTTAATCATTTTGCCTCTTTTCT

CTGTGCTTCAATTAATAAAAAATGGAAAGAACCT SEQ ID NO:

1383 corresponding to SEQ ID NO: 1376 of the patent application WO2013/143700)
```

In this context, it is particularly preferred that the 3'-UTR element of the mRNA according to the present invention comprises or consists of a corresponding RNA sequence of the nucleic acid sequence according to SEQ ID NO: 1383 or 1385 as shown in SEQ ID NO: 1384 or SEQ ID NO: 1386.

In another particularly preferred embodiment, the 3'-UTR element comprises or consists of a nucleic acid sequence which is derived from a 3'-UTR of an α- or β-globin gene, preferably a vertebrate α- or β-globin gene, more preferably a mammalian α- or β-globin gene, most preferably a human α- or β-globin gene according to SEQ ID NO: 1373, 1375, 1377, or the corresponding RNA sequences SEQ ID NO: 1374, 1376, 1378

```
3'-UTR of Homo sapiens hemoglobin, alpha 1 (HBA1)
GCTGGAGCCTCGGTGGCCATGCTTCTTGCCCCTTGGGCCTCCCCCCAGC

CCCTCCTCCCCTTCCTGCACCCGTACCCCCGTGGTCTTTGAATAAAGTC

TGAGTGGGCGGC (SEQ ID NO: 1373 corresponding to

SEQ ID NO: 1370 of the patent application

WO2013/143700)

3'-UTR of Homo sapiens hemoglobin, alpha 2 (HBA2)
GCTGGAGCCTCGGTAGCCGTTCCTCCTGCCCGCTGGGCCTCCCAACGGG

CCCTCCTCCCCTCCTTGCACCGGCCCTTCCTGGTCTTTGAATAAAGTCT

GAGTGGGCAG (SEQ ID NO: 1375 corresponding to SEQ

ID NO: 1371 of the patent application WO2013/

143700)

3'-UTR of Homo sapiens hemoglobin, beta (HBB)
GCTCGCTTTCTTGCTGTCCAATTTCTATTAAAGGTTCCTTTGTTCCCTA

AGTCCAACTACTAAACTGGGGGATATTATGAAGGGCCTTGAGCATCTGG

ATTCTGCCTAATAAAAAACATTTATTTTCATTGC (SEQ ID NO:

1377 corresponding to SEQ ID NO: 1372 of the patent application WO2013/143700)
```

For example, the 3'-UTR element may comprise or consist of the center, α-complex-binding portion of the 3'-UTR of an α-globin gene, such as of a human α-globin gene, or a homolog, a fragment, or a variant of an α-globin gene, preferably according to SEQ ID NO: 1379:

Center, α-complex-binding portion of the 3'-UTR of an α-globin gene (also named herein as "muag") GCCC-GATGGGCCTCC-CAACGGGCCCTCCTCCCCTCCTTGCACCG (SEQ ID NO: 1379 corresponding to SEQ ID NO: 1393 of the patent application WO2013/143,700).

In this context it is particularly preferred that the 3'-UTR element of the mRNA according to the invention comprises or consists of a corresponding RNA sequence of the nucleic acid sequence according to SEQ ID NO: 1379 as shown in SEQ ID NO: 1380, or a homolog, a fragment or variant thereof.

The term "a nucleic acid sequence which is derived from the 3'-UTR of a [ . . . ] gene" preferably refers to a nucleic acid sequence which is based on the 3'-UTR sequence of a [ . . . ] gene or on a part thereof, such as on the 3'-UTR of an albumin gene, an α-globin gene, a β-globin gene, a tyrosine hydroxylase gene, a lipoxygenase gene, or a collagen alpha gene, such as a collagen alpha 1(I) gene, preferably of an albumin gene or on a part thereof. This term includes sequences corresponding to the entire 3'-UTR sequence, i.e. the full length 3'-UTR sequence of a gene, and sequences corresponding to a fragment of the 3'-UTR sequence of a gene, such as an albumin gene, α-globin gene, β-globin gene, tyrosine hydroxylase gene, lipoxygenase gene, or collagen alpha gene, such as a collagen alpha 1(I) gene, preferably of an albumin gene.

The term "a nucleic acid sequence which is derived from a variant of the 3'-UTR of a [ . . . ] gene" preferably refers to a nucleic acid sequence, which is based on a variant of the 3'-UTR sequence of a gene, such as on a variant of the 3'-UTR of an albumin gene, an α-globin gene, a β-globin gene, a tyrosine hydroxylase gene, a lipoxygenase gene, or a collagen alpha gene, such as a collagen alpha 1(I) gene, or on a part thereof as described above. This term includes sequences corresponding to the entire sequence of the variant of the 3'-UTR of a gene, i.e. the full length variant 3'-UTR sequence of a gene, and sequences corresponding to a fragment of the variant 3-UTR sequence of a gene. A fragment in this context preferably consists of a continuous stretch of nucleotides corresponding to a continuous stretch of nucleotides in the full-length variant 3'-UTR, which represents at least 20%, preferably at least 30%, more preferably at least 40%, more preferably at least 50%, even more preferably at least 60%, even more preferably at least 70%, even more preferably at least 80%, and most preferably at least 90% of the full-length variant 3'-UTR. Such a fragment of a variant, in the sense of the present invention, is preferably a functional fragment of a variant as described herein.

According to a preferred embodiment, the mRNA according to the invention comprises a 5'-cap structure and/or at least one 3'-untranslated region element (3'-UTR element), preferably as defined herein. More preferably, the mRNA further comprises a 5'-UTR element as defined herein.

In a preferred embodiment the mRNA comprises, preferably in 5'- to 3'-direction:
a.) a 5'-cap structure, preferably m7GpppN;
b.) at least one coding region encoding at least one antigenic peptide or protein comprising or consisting of a protein of a MERS coronavirus, or a fragment or variant thereof,
c.) optionally a 3'-UTR element, preferably comprising or consisting of a nucleic acid sequence which is derived from an alpha globin gene, preferably comprising the corresponding RNA sequence of the nucleic acid sequence according to SEQ ID NO: 1379, a homolog, a fragment or a variant thereof;
d.) optionally, a poly(A) sequence, preferably comprising 64 adenosines;
e.) optionally, a poly(C) sequence, preferably comprising 30 cytosines; and In a particularly preferred embodiment the mRNA comprises, preferably in 5'- to 3'-direction:
a.) a 5'-cap structure, preferably m7GpppN;
b.) at least one coding region encoding at least one antigenic peptide or protein comprising or consisting of a protein of a MERS coronavirus, or a fragment or variant thereof, preferably comprising or consisting of any one of the nucleic acid sequences defined in the column 3 ("B"; SEQ ID NO: 153-304) or column 4 ('C'; SEQ ID NO: 305-1368) of Tables 1-4, or a fragment or variant of any one of these nucleic acid sequences,
c.) optionally a 3'-UTR element, preferably comprising or consisting of a nucleic acid sequence which is derived from an alpha globin gene, preferably comprising the corresponding RNA sequence of the nucleic acid sequence according to SEQ ID NO: 1379, a homolog, a fragment or a variant thereof;
d.) optionally, a poly(A) sequence, preferably comprising 64 adenosines;
e.) optionally, a poly(C) sequence, preferably comprising 30 cytosines; and 5'-UTR elements:

In a particularly preferred embodiment, the mRNA according to the invention comprises at least one 5'-untranslated region element (5'-UTR element). Preferably, the at least one 5'-UTR element comprises or consists of a nucleic acid sequence, which is derived from the 5'-UTR of a TOP gene or which is derived from a fragment, homolog or variant of the 5'-UTR of a TOP gene.

It is particularly preferred that the 5'-UTR element does not comprise a TOP-motif or a 5'-TOP, as defined above.

In some embodiments, the nucleic acid sequence of the 5'-UTR element, which is derived from a 5'-UTR of a TOP gene, terminates at its 3'-end with a nucleotide located at position 1, 2, 3, 4, 5, 6, 7, 8, 9 or 10 upstream of the start codon (e.g. A(U/T)G) of the gene or mRNA it is derived from. Thus, the 5'-UTR element does not comprise any part of the protein coding region. Thus, preferably, the only protein coding part of the mRNA according to the invention is provided by the coding region.

The nucleic acid sequence derived from the 5'-UTR of a TOP gene is preferably derived from a eukaryotic TOP gene, preferably a plant or animal TOP gene, more preferably a chordate TOP gene, even more preferably a vertebrate TOP gene, most preferably a mammalian TOP gene, such as a human TOP gene.

For example, the 5'-UTR element is preferably selected from 5'-UTR elements comprising or consisting of a nucleic acid sequence, which is derived from a nucleic acid sequence selected from the group consisting of SEQ ID NOs: 1-1363, SEQ ID NO: 1395, SEQ ID NO: 1421 and SEQ ID NO: 1422 of the patent application WO2013/143,700, whose disclosure is incorporated herein by reference, from the homologs of SEQ ID NOs: 1-1363, SEQ ID NO: 1395, SEQ ID NO: 1421 and SEQ ID NO: 1422 of the patent application WO2013/143,700, from a variant thereof, or preferably from a corresponding RNA sequence. The term "homologs of SEQ ID NOs: 1-1363, SEQ ID NO: 1395, SEQ ID NO: 1421 and SEQ ID NO: 1422 of the patent application WO2013/143,700" refers to sequences of other species than *Homo sapiens*, which are homologous to the sequences according to SEQ ID NOs: 1-1363, SEQ ID NO: 1395, SEQ ID NO: 1421 and SEQ ID NO: 1422 of the patent application WO2013/143,700.

In a preferred embodiment, the 5'-UTR element of the mRNA according to the invention comprises or consists of a nucleic acid sequence, which is derived from a nucleic acid sequence extending from nucleotide position 5 (i.e. the nucleotide that is located at position 5 in the sequence) to the nucleotide position immediately 5' to the start codon (located at the 3'-end of the sequences), e.g. the nucleotide position immediately 5' to the ATG sequence, of a nucleic acid sequence selected from SEQ ID NOs: 1-1363, SEQ ID NO: 1395, SEQ ID NO: 1421 and SEQ ID NO: 1422 of the patent application WO2013/143,700, from the homologs of SEQ ID NOs: 1-1363, SEQ ID NO: 1395, SEQ ID NO: 1421 and SEQ ID NO: 1422 of the patent application WO2013/143,700 from a variant thereof, or a corresponding RNA sequence. It is particularly preferred that the 5'-UTR element is derived from a nucleic acid sequence extending from the nucleotide position immediately 3' to the 5'-TOP to the nucleotide position immediately 5' to the start codon (located at the 3'-end of the sequences), e.g. the nucleotide position immediately 5' to the ATG sequence, of a nucleic acid sequence selected from SEQ ID NOs: 1-1363, SEQ ID NO: 1395, SEQ ID NO: 1421 and SEQ ID NO: 1422 of the patent application WO2013/143,700, from the homologs of SEQ ID NOs: 1-1363, SEQ ID NO: 1395, SEQ ID NO: 1421 and SEQ ID NO: 1422 of the patent application WO2013/143,700, from a variant thereof, or a corresponding RNA sequence.

In a particularly preferred embodiment, the 5'-UTR element comprises or consists of a nucleic acid sequence, which is derived from a 5'-UTR of a TOP gene encoding a ribosomal protein or from a variant of a 5'-UTR of a TOP gene encoding a ribosomal protein. For example, the 5'-UTR element comprises or consists of a nucleic acid sequence, which is derived from a 5'-UTR of a nucleic acid sequence according to any of SEQ ID NOs: 67, 170, 193, 244, 259, 554, 650, 675, 700, 721, 913, 1016, 1063, 1120, 1138, and 1284-1360 of the patent application WO2013/143,700, a corresponding RNA sequence, a homolog thereof, or a variant thereof as described herein, preferably lacking the 5'-TOP motif. As described above, the sequence extending from position 5 to the nucleotide immediately 5' to the ATG (which is located at the 3'-end of the sequences) corresponds to the 5'-UTR of said sequences.

Preferably, the 5'-UTR element comprises or consists of a nucleic acid sequence, which is derived from a 5'-UTR of a TOP gene encoding a ribosomal Large protein (RPL) or from a homolog or variant of a 5'-UTR of a TOP gene encoding a ribosomal Large protein (RPL). For example, the 5'-UTR element comprises or consists of a nucleic acid sequence, which is derived from a 5'-UTR of a nucleic acid sequence according to any of SEQ ID NOs: 67, 259, 1284-1318, 1344, 1346, 1348-1354, 1357, 1358, 1421 and 1422 of the patent application WO2013/143,700, a corresponding RNA sequence, a homolog thereof, or a variant thereof as described herein, preferably lacking the 5'-TOP motif.

In a particularly preferred embodiment, the 5'-UTR element comprises or consists of a nucleic acid sequence which is derived from the 5'-UTR of a ribosomal protein Large 32 gene, preferably from a vertebrate ribosomal protein Large 32 (L32) gene, more preferably from a mammalian ribosomal protein Large 32 (L32) gene, most preferably from a human ribosomal protein Large 32 (L32) gene, or from a variant of the 5'-UTR of a ribosomal protein Large 32 gene, preferably from a vertebrate ribosomal protein Large 32 (L32) gene, more preferably from a mammalian ribosomal protein Large 32 (L32) gene, most preferably from a human ribosomal protein Large 32 (L32) gene, wherein preferably the 5'-UTR element does not comprise the 5'-TOP of said gene.

Accordingly, in a particularly preferred embodiment, the 5'-UTR element comprises or consists of a nucleic acid sequence, which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 1369 (5'-UTR of human ribosomal protein Large 32 lacking the 5'-terminal oligopyrimidine tract: GGCGCTGCCTACGGAGGTGGCAGC-CATCTCCTTCTCGGCATC; corresponding to SEQ ID NO: 1368 of the patent application WO2013/143,700) or preferably to a corresponding RNA sequence (SEQ ID NO: 1370), or wherein the at least one 5'-UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 1369 or more preferably to a corresponding RNA sequence (SEQ ID NO: 1370), wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

In some embodiments, the mRNA according to the invention comprises a 5'-UTR element, which comprises or consists of a nucleic acid sequence, which is derived from the 5'-UTR of a vertebrate TOP gene, such as a mammalian, e.g. a human TOP gene, selected from RPSA, RPS2, RPS3, RPS3A, RPS4, RPS5, RPS6, RPS7, RPS8, RPS9, RPS10, RPS11, RPS12, RPS13, RPS14, RPS15, RPS15A, RPS16, RPS17, RPS18, RPS19, RPS20, RPS21, RPS23, RPS24, RPS25, RPS26, RPS27, RPS27A, RPS28, RPS29, RPS30, RPL3, RPL4, RPL5, RPL6, RPL7, RPL7A, RPL8, RPL9, RPL10, RPL10A, RPL11, RPL12, RPL13, RPL13A, RPL14, RPL15, RPL17, RPL18, RPL18A, RPL19, RPL21, RPL22, RPL23, RPL23A, RPL24, RPL26, RPL27, RPL27A, RPL28, RPL29, RPL30, RPL31, RPL32, RPL34, RPL35, RPL35A, RPL36, RPL36A, RPL37, RPL37A, RPL38, RPL39, RPL40, RPL41, RPLP0, RPLP1, RPLP2, RPLP3, RPLP0, RPLP1, RPLP2, EEF1A1, EEF1B2, EEF1D, EEF1G, EEF2, EIF3E, EIF3F, EIF3H, EIF2S3, EIF3C, EIF3K, EIF3EIP, EIF4A2, PABPC1, HNRNPA1, TPT1, TUBB1, UBA52, NPM1, ATP5G2, GNB2L1, NME2, UQCRB, or from a homolog or variant thereof, wherein preferably the 5'-UTR element does not comprise a TOP-motif or the 5'-TOP of said genes, and wherein optionally the 5'-UTR element starts at its 5'-end with a nucleotide located at position 1, 2, 3, 4, 5, 6, 7, 8, 9 or 10 downstream of the 5'-terminal oligopyrimidine tract (TOP) and wherein further optionally the 5'-UTR element which is derived from a 5'-UTR of a TOP gene terminates at its 3'-end with a nucleotide located at position 1, 2, 3, 4, 5, 6, 7, 8, 9 or 10 upstream of the start codon (A(U/T)G) of the gene it is derived from.

In further particularly preferred embodiments, the 5'-UTR element comprises or consists of a nucleic acid sequence, which is derived from the 5'-UTR of a ribosomal protein Large 32 gene (RPL32), a ribosomal protein Large 35 gene (RPL35), a ribosomal protein Large 21 gene (RPL21), an ATP synthase, H+ transporting, mitochondrial F1 complex, alpha subunit 1, cardiac muscle (ATP5A1) gene, an hydroxysteroid (17-beta) dehydrogenase 4 gene (HSD17B4), an androgen-induced 1 gene (AIG1), cytochrome c oxidase subunit VIc gene (COX6C), or a N-acylsphingosine amidohydrolase (acid ceramidase) 1 gene (ASAH1) or from a variant thereof, preferably from a vertebrate ribosomal protein Large 32 gene (RPL32), a vertebrate ribosomal protein Large 35 gene (RPL35), a vertebrate ribosomal protein Large 21 gene (RPL21), a vertebrate ATP synthase, H+ transporting, mitochondrial F1 complex, alpha subunit 1, cardiac muscle (ATP5A1) gene, a vertebrate hydroxysteroid (17-beta) dehydrogenase 4 gene (HSD17B4), a vertebrate androgen-induced 1 gene (AIG1), a vertebrate cytochrome c oxidase subunit VIc gene (COX6C), or a vertebrate N-acylsphingosine amidohydrolase (acid ceramidase) 1 gene (ASAH1) or from a variant thereof, more preferably from a mammalian ribosomal protein Large 32 gene (RPL32), a ribosomal protein Large 35 gene (RPL35), a ribosomal protein Large 21 gene (RPL21), a mammalian ATP synthase, H+ transporting, mitochondrial F1 complex, alpha subunit 1, cardiac muscle (ATP5A1) gene, a mammalian hydroxysteroid (17-beta) dehydrogenase 4 gene (HSD17B4), a mammalian androgen-induced 1 gene (AIG1), a mammalian cyto-chrome c oxidase subunit VIc gene (COX6C), or a mammalian N-acylsphingosine amidohydrolase (acid ceramidase) 1 gene (ASAH1) or from a variant thereof, most preferably from a human ribosomal protein Large 32 gene (RPL32), a human ribosomal protein Large 35 gene (RPL35), a human ribosomal protein Large 21 gene (RPL21), a human ATP synthase, H+ transporting, mitochondrial F1 complex, alpha subunit 1, cardiac muscle (ATP5A1) gene, a human hydroxysteroid (17-beta) dehydrogenase 4 gene (HSD17B4), a human androgen-induced 1 gene (AIG1), a human cytochrome c oxidase subunit VIc gene (COX6C), or a human N-acylsphingosine amidohydrolase (acid ceramidase) 1 gene (ASAH1) or from a variant thereof, wherein preferably the 5'-UTR element does not comprise the 5'TOP of said gene.

Accordingly, in a particularly preferred embodiment, the 5'-UTR element comprises or consists of a nucleic acid sequence, which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 1368, or SEQ ID NOs: 1412-1420 of the patent application WO2013/143,700, or a corresponding RNA sequence, or wherein the at least one 5'-UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 1368, or SEQ ID NOs: 1412-1420 of the patent application WO2013/143,700, wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

Accordingly, in a particularly preferred embodiment, the 5'-UTR element comprises or consists of a nucleic acid sequence, which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 1371 (5'-UTR of ATP5A1 lacking the 5'-terminal oligopyrimidine tract: GCGGCTCGGCCAGTCCCAGTCAGTCCG-GAGGCTGCGGCTGCAGAAGTACCGCCTGCG-GAGTAACTGCAAAG; corresponding to SEQ ID NO: 1414 of the patent application WO2013/143,700) or preferably to a corresponding RNA sequence (SEQ ID NO: 1372), or wherein the at least one 5'-UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 1371 or more preferably to a corresponding RNA sequence (SEQ ID NO: 1372), wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

Preferably, the at least one 5-UTR element and the at least one 3'-UTR element act synergistically to increase protein production from the mRNA as described above.

According to a preferred embodiment, the mRNA according to the invention comprises, preferably in 5'- to 3'-direction:

a.) a 5'-cap structure, preferably m7GpppN;
b.) optionally a 5'-UTR element which preferably comprises or consists of a nucleic acid sequence which is derived from the 5-UTR of a TOP gene, more preferably comprising or consisting of the corresponding RNA sequence of a nucleic acid sequence according to SEQ ID NO: 1369, a homolog, a fragment or a variant thereof;
c.) at least one coding region encoding at least one antigenic peptide or protein comprising or consisting of a protein of MERS coronavirus or a fragment or variant thereof, preferably comprising or consisting of any one of the nucleic acid sequences defined in the in the column 3 ("B"; SEQ ID NO: 153-304) or column 4 (; SEQ ID NO: 305-1368) of Tables 1-4, or a fragment or variant of any one of these nucleic acid sequences, d.) optionally a 3'-UTR element which preferably comprises or consists of a nucleic acid sequence which is derived from a gene providing a stable mRNA, preferably comprising or consisting of the corresponding RNA sequence of a nucleic acid sequence according to SEQ ID NO: 1383 or 1385, a homolog, a fragment or a variant thereof;

e.) optionally a poly(A) sequence preferably comprising 64 adenosines; and f.) optionally a poly(C) sequence, preferably comprising 30 cytosines.

Histone Stem-Loop:

In a particularly preferred embodiment, the mRNA according to the invention comprises a histone stem-loop sequence/structure. Such histone stem-loop sequences are preferably selected from histone stem-loop sequences as disclosed in WO2012/019780, the disclosure of which is incorporated herewith by reference.

A histone stem-loop sequence, suitable to be used within the present invention, is preferably selected from at least one of the following formulae (I) or (II):

formula (I)

(stem loop sequence without stem bordering elements):

$$\underbrace{[N_{0-2}GN_{3-5}]}_{\text{stem1}}\ \underbrace{[N_{0-4}(U/T)N_{0-4}]}_{\text{loop}}\ \underbrace{[N_{3-5}CN_{0-2}]}_{\text{stem2}}$$

formula (II)

(stem loop sequence with stem bordering elements):

$$\underbrace{N_{1-6}}_{\text{stem1 bordering element}}\ \underbrace{[N_{0-2}GN_{3-5}]}_{\text{stem1}}\ \underbrace{[N_{0-4}(U/T)N_{0-4}]}_{\text{loop}}\ \underbrace{[N_{3-5}CN_{0-2}]}_{\text{stem2}}\ \underbrace{N_{1-6}}_{\text{stem2 bordering element}}$$

wherein:

stem1 or stem2 bordering elements $N_{1-6}$ is a consecutive sequence of 1 to 6, preferably of 2 to 6, more preferably of 2 to 5, even more preferably of 3 to 5, most preferably of 4 to 5 or 5 N, wherein each N is independently from another selected from a nucleotide selected from A, U, T, G and C, or a nucleotide analogue thereof;

stem1 $[N_{0-2}GN_{3-5}]$ is reverse complementary or partially reverse complementary with element stem2, and is a consecutive sequence between of 5 to 7 nucleotides;

wherein $N_{0-2}$ is a consecutive sequence of 0 to 2, preferably of 0 to 1, more preferably of 1 N, wherein each N is independently from another selected from a nucleotide selected from A, U, T, G and C or a nucleotide analogue thereof;

wherein $N_{3-5}$ is a consecutive sequence of 3 to 5, preferably of 4 another selected from a nucleotide selected from A, U, T, G and C or a nucleotide analogue thereof, and wherein G is guanosine or an analogue thereof, and may be optionally replaced by a cytidine or an analogue thereof, provided that its complementary nucleotide cytidine in stem2 is replaced by guanosine;

loop sequence $[N_{0-4}(U/T)N_{0-4}]$ is located between elements stem1 and stem2, and is a consecutive sequence of 3 to 5 nucleotides, more preferably of 4 nucleotides;

wherein each $N_{0-4}$ is independent from another a consecutive sequence of 0 to 4, preferably of 1 to 3, more preferably of 1 to 2 N, wherein each N is independently from another selected from a nucleotide selected from A, U, T, G and C or a nucleotide analogue thereof; and wherein U/T represents uridine, or optionally thymidine;

stem2 $[N_{3-5}CN_{0-2}]$ is reverse complementary or partially reverse complementary with element stem1, and is a consecutive sequence between of 5 to 7 nucleotides;

wherein $N_{3-5}$ is a consecutive sequence of 3 to 5, preferably of 4 to 5, more preferably of 4 N, wherein each N is independently from another selected from a nucleotide selected from A, U, T, G and C or a nucleotide analogue thereof;

wherein $N_{0-2}$ is a consecutive sequence of 0 to 2, preferably of 0 to 1, more preferably of 1 N, wherein each N is independently from another selected from a nucleotide selected from A, U, T, G or C or a nucleotide analogue thereof; and wherein C is cytidine or an analogue thereof, and may be optionally replaced by a guanosine or an analogue thereof provided that its complementary nucleoside guanosine in stem1 is replaced by cytidine;

wherein stem1 and stem2 are capable of base pairing with each other forming a reverse complementary sequence, wherein base pairing may occur between stem1 and stem2, e.g. by Watson-Crick base pairing of nucleotides A and U/T or G and C or by non-Watson-Crick base pairing e.g. wobble base pairing, reverse Watson-Crick base pairing, Hoogsteen base pairing, reverse Hoogsteen base pairing or are capable of base pairing with each other forming a partially reverse complementary sequence, wherein an incomplete base pairing may occur between stem1 and stem2, on the basis that one or more bases in one stem do not have a complementary base in the reverse complementary sequence of the other stem.

According to a further preferred embodiment the inventive mRNA may comprise at least one histone stem-loop sequence according to at least one of the following specific formulae (Ia) or (IIa):

formula (Ia)
(stem loop sequence without stem bordering elements):

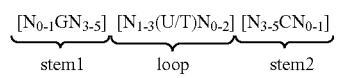

formula (IIa)
(stem loop sequence with stem bordering elements):

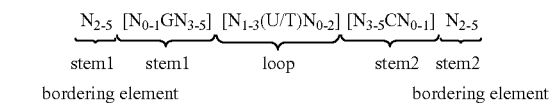

wherein:
N, C, G, T and U are as defined above.

According to a further more particularly preferred embodiment, the at least one mRNA of the inventive composition may comprise at least one histone stem-loop sequence according to at least one of the following specific formulae (Ib) or (IIb):

formula (Ib)
(stem loop sequence without stem bordering elements):

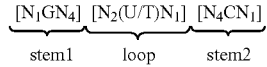

formula (IIb)
(stem loop sequence with stem bordering elements):

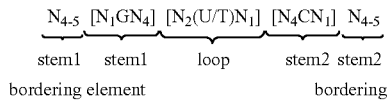

wherein:
N, C, G, T and U are as defined above.

A particular preferred histone stem-loop sequence is the sequence CAAAGGCTCTTTTCAGAGCCACCA (according to SEQ ID NO: 1387) or more preferably the corresponding RNA sequence CAAAGGCUCUUUUCAGAGCCACCA (according to SEQ ID NO: 1388).

Accordingly, in preferred embodiments, the artificial nucleic acid of the invention comprises at least one histone stem-loop as defined herein. Preferably, the at least one histone stem loop comprises a nucleic acid sequence according to SEQ ID NOs: 1387 or 1388, or a fragment or variant thereof.

In particularly preferred embodiments, the artificial nucleic acid, preferably the artificial mRNA of the invention comprises a 3'-terminal sequence element comprising a poly(A)sequence as defined herein and a histons-stem-loop sequence as defined herein, wherein the 3'-terminal sequence element may be selected from SEQ ID NOs: 1444, 1445, 1446 or 1447.

Any of the above modifications may be applied to the mRNA of the present invention, and further to any mRNA as used in the context of the present invention and may be, if suitable or necessary, be combined with each other in any combination, provided, these combinations of modifications do not interfere with each other in the respective mRNA sequence. A person skilled in the art will be able to take his choice accordingly.

The mRNA according to the invention, which comprises at least one coding region as defined herein, may preferably comprise a 5'-UTR and/or a 3'-UTR preferably containing at least one histone stem-loop. The 3'-UTR of the mRNA according to the invention preferably comprises also a poly(A) and/or a poly(C) sequence as defined herein. The single elements of the 3'-UTR may occur therein in any order from 5' to 3' along the sequence of the mRNA of the present invention. In addition, further elements as described herein, may also be contained, such as a stabilizing sequence as defined herein (e.g. derived from the UTR of a globin gene), IRES sequences, etc. Each of the elements may also be repeated in the mRNA according to the invention at least once (particularly in di- or multicistronic constructs), preferably twice or more. As an example, the single elements may be present in the mRNA according to the invention in the following order:

5'-coding region-histone stem-loop-poly(A)/(C) sequence-3'; or

5'-coding region-poly(A)/(C) sequence-histone stem-loop-3'; or

5'-coding region-histone stem-loop-polyadenylation signal-3'; or

5'-coding region-polyadenylation signal-histone stem-loop-3'; or

5"-coding region-histone stem-loop-histone stem-loop-poly(A)/(C) sequence-3'; or 5'-coding region-histone stem-loop-histone stem-loop-polyadenylation signal-3'; or 5'-coding region-stabilizing sequence-poly(A)/(C) sequence-histone stem-loop-3'; or 5'-coding region-stabilizing sequence-poly(A)/(C) sequence-poly(A)/(C) sequence-histone stem-loop-3'; etc.

According to a further embodiment, the mRNA of the present invention preferably comprises at least one of the following structural elements: a 5'- and/or 3'-untranslated region element (UTR element), particularly a 5'-UTR element, which preferably comprises or consists of a nucleic acid sequence which is derived from the 5'-UTR of a TOP gene or from a fragment, homolog or a variant thereof, or a 5'- and/or 3'-UTR element which may preferably be derivable from a gene that provides a stable mRNA or from a homolog, fragment or variant thereof; a histone-stem-loop structure, preferably a histone-stem-loop in its 3' untranslated region; a 5'-cap structure; a poly-A tail; or a poly(C) sequence.

In a particularly preferred embodiment, the mRNA comprises, preferably in 5'- to 3'-direction:

a.) a 5'-cap structure, preferably m7GpppN;

b.) at least one coding region encoding at least one antigenic peptide or protein comprising or consisting of a protein of MERS coronavirus, or a fragment or variant thereof, preferably comprising or consisting of any one of the nucleic acid sequences defined in column 3 ("B"; SEQ ID NO: 153-304) or column 4 ('C'; SEQ ID NO: 305-1368) of Tables 1-4, or a fragment or variant of any one of these nucleic acid sequences, c.) optionally a 3'-UTR element comprising or consisting of a nucleic acid sequence which is derived from an alpha globin gene, preferably comprising the corresponding RNA sequence of the nucleic acid sequence according to SEQ ID NO: 1379, a homolog, a fragment or a variant thereof;

d.) optionally, a poly(A) sequence, preferably comprising 64 adenosines;

e.) optionally, a poly(C) sequence, preferably comprising 30 cytosines;

f.) optionally, a histone stem-loop, preferably comprising the RNA sequence according to SEQ ID NO: 1388, and g.) optionally, a poly(A) sequence and a histone stem-loop comprising the RNA sequence according to SEQ ID NOs: 6412, 6413, 6414 or 6415

According to another particularly preferred embodiment the mRNA sequence according to the invention comprises, preferably in 5'- to 3'-direction:

a.) a 5'-cap structure, preferably m7GpppN;

b.) a 5'-UTR element which comprises or consists of a nucleic acid sequence which is derived from the 5'-UTR of a TOP gene, preferably comprising or consisting of the corresponding RNA sequence of a nucleic acid sequence according to SEQ ID NO: 1369, a homolog, a fragment or a variant thereof;

c.) at least one coding region encoding at least one antigenic peptide or protein comprising or consisting of a protein of a MERS coronavirus or a fragment or variant thereof, preferably comprising or consisting of any one of the nucleic acid sequences defined in column 3 ("B"; SEQ ID NO: 153-304) or column 4 ('C'; SEQ ID NO: 305-1368) of Tables 1-4, or a fragment or variant of any one of these nucleic acid sequences, d.) optionally a 3'-UTR element comprising or consisting of a nucleic acid sequence which is derived from a gene providing a stable mRNA, preferably comprising or consisting of the corresponding RNA sequence of a nucleic acid sequence according to SEQ ID NO: 1383 or 1385, a homolog, a fragment or a variant thereof;

e.) optionally a poly(A) sequence preferably comprising 64 adenosines;

f.) optionally a poly(C) sequence, preferably comprising 30 cytosines; and g.) optionally, a histone stem-loop, preferably comprising the RNA sequence according to SEQ ID NO: SEQ ID NO: 1388.

The mRNA according to the present invention may be prepared using any method known in the art, including synthetic methods such as e.g. solid phase RNA synthesis, as well as in vitro methods, such as RNA in vitro transcription reactions.

Accordingly, it is particularly preferred that the mRNA according to the invention comprises or consists of an RNA sequence which is identical or at least 50%, 60%, 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 2367, 2368, 2369, 2370, 2371, 2372, 2373, 2374, 2375, 2376, 2377 or 2378 or a fragment or variant of any of these sequences.

Composition:

In a further aspect, the present invention provides a composition comprising the mRNA of the invention, and at least one pharmaceutically acceptable carrier. In particular, the composition according to the invention comprises at least one mRNA, preferably as described herein, encoding at least one antigenic peptide or protein comprising or consisting of a spike protein (S or S_stabilized), a spike S1 fragment (S1), a nucleocapsid protein (N), a membrane protein (M) or an envelope protein (E) of a MERS coronavirus, or from a fragment or variant of any one of these proteins. The composition according to the invention is preferably provided as a pharmaceutical composition or as a vaccine.

A "vaccine" is typically understood to be a prophylactic or therapeutic material providing at least one epitope of an antigen, preferably an immunogen. "Providing at least on epitope" means, for example, that the vaccine comprises the epitope (or antigen comprising or providing said epitope) or that the vaccine comprises a molecule that, e.g., encodes the epitope or an antigen comprising or providing the epitope.

The antigen preferably stimulates the adaptive immune system to provide an adaptive immune response.

The (pharmaceutical) composition or vaccine provided herein may further comprise at least one pharmaceutically acceptable excipient, adjuvant or further component (e.g. additives, auxiliary substances, and the like).

In preferred embodiments, the (pharmaceutical) composition or vaccine according to the invention comprises a plurality or more than one of the inventive mRNAs as described herein.

In some embodiments, each of the mRNAs comprises a coding region encoding at least one different antigenic peptide or protein comprising or consisting of proteins, or a fragment or variant thereof, of the same MERS coronavirus. In other embodiments, each of the mRNAs comprises a coding region which encodes at least one different antigenic peptide or protein comprising or consisting of different proteins, or a fragment or variant thereof, of the same MERS coronavirus. In some embodiments, each of the mRNAs comprises a coding region which encodes at least one different antigenic peptide or protein comprising or consisting of different proteins, or a fragment or variant thereof, of different MERS coronaviruses. In said embodiments, the antigenic peptides or proteins preferably comprise or consist of a spike protein (S or S_stabilized), a spike S1 fragment (S1), a nucleocapsid protein (N), a membrane protein (M) and/or an envelope protein (E) of a MERS coronavirus, or a variant or fragment of any of these proteins. Specifically, a spike protein (S or S_stabilized), a spike S1 fragment (S1), a nucleocapsid protein (N), a membrane protein (M) and/or an envelope protein (E) of a MERS coronavirus encoded by the plurality of mRNAs may be derived from 2, 3, 4 or more different MERS coronaviruses, or may be derived from the same MERS coronavirus.

Accordingly, the (pharmaceutical) composition or vaccine according to the invention may comprise an mRNA as defined herein, wherein said mRNA encodes one specific antigenic peptide or protein as defined herein. In such embodiments, the (pharmaceutical) composition or vaccine preferably comprises an inventive mRNA comprising the at least one coding sequence as defined herein encoding said antigenic peptide or protein.

Alternatively, the (pharmaceutical) composition or vaccine of the present invention may comprise, an mRNA as defined herein, wherein said mRNA encodes at least two, three, four, five, six, seven, eight, nine, ten, eleven or twelve distinct antigenic peptides or proteins (or variants or fragments thereof) as defined herein. In such embodiments, the (pharmaceutical) composition or vaccine preferably comprises several species of the inventive mRNA, wherein each mRNA species encodes a distinct antigenic peptide or protein as defined herein.

In other embodiments, the mRNA comprised in the (pharmaceutical) composition or vaccine is a bi- or multicistronic mRNA as defined herein, which encodes the at least two, three, four, five, six, seven, eight, nine, ten, eleven or twelve distinct antigenic peptides or proteins as defined herein.

Mixtures between these embodiments are also envisaged, such as compositions comprising more than one mRNA species, wherein at least one mRNA species may be monocistronic, while at least one other mRNA species may be bi- or multicistronic The (pharmaceutical) composition or vaccine according to the present invention, preferably the at least one coding sequence of the mRNA comprised therein, may thus comprise any combination of the nucleic acid sequences as defined herein.

Preferably, the (pharmaceutical) composition or vaccine comprises a plurality or more than one of the mRNAs according to the invention, wherein each mRNA comprises at least one coding region encoding at least one antigenic peptide or protein comprising or consisting of a protein of a MERS coronavirus or a fragment or variant thereof.

In a particularly preferred embodiment, the composition comprises at least 2, 3, 4, 5, 6, 7, 6, 9, 10, 11, 12, 13, 14, 15, 16, 17, 18, 19, 20, 25, 30, 35, 40, 45, 50, 60, 70, 80, or 100 different mRNAs each encoding at least one antigenic peptide or protein comprising or consisting of a MERS coronavirus protein, or a fragment or variant thereof as described herein.

Complexation and Formulation:

In a preferred embodiment of the composition according to the invention, the at least one mRNA according to the invention is complexed with one or more cationic or polycationic compounds, preferably with cationic or polycationic polymers, cationic or polycationic peptides or proteins, e.g. protamine, cationic or polycationic polysaccharides and/or cationic or polycationic lipids.

According to a preferred embodiment, the at least one mRNA of the composition according to the present invention may be complexed with lipids to form one or more liposomes, lipoplexes, or lipid nanoparticles. Therefore, in one embodiment, the inventive composition comprises liposomes, lipoplexes, and/or lipid nanoparticles comprising the at least one mRNA.

In this context, the terms "complexed" or "associated" refer to the essentially stable combination of said mRNA with one or more of the aforementioned compounds into larger complexes or assemblies without covalent binding.

According to some preferred embodiments, the mRNA, optionally comprised by the (pharmaceutical) composition or vaccine, is complexed or associated with lipids (in particular cationic and/or neutral lipids) to form one or more liposomes, lipoplexes, lipid nanoparticles or nanoliposomes.

Preferably, lipid nanoparticles (LNPs) comprise: (a) at least one mRNA, optionally comprised by the (pharmaceutical) composition or vaccine as defined herein, (b) a cationic lipid, (c) an aggregation reducing agent (such as polyethylene glycol (PEG) lipid or PEG-modified lipid), (d) optionally a non-cationic lipid (such as a neutral lipid), and (e) optionally, a sterol.

In the context of the present invention, the term "lipid nanoparticle", also referred to as "LNP", is not restricted to any particular morphology, and includes any morphology generated when a cationic lipid and optionally one or more further lipids are combined, e.g. in an aqueous environment and/or in the presence of an RNA. For example, a liposome, a lipid complex, a lipoplex, an emulsion, a micelle, a lipidic nanocapsule, a nanosuspension and the like are within the scope of a lipid nanoparticle (LNP).

In some embodiments, LNPs comprise, in addition to the at least one mRNA, optionally comprised by the (pharmaceutical) composition or vaccine as defined herein, (i) at least one cationic lipid; (ii) a neutral lipid; (iii) a sterol, e.g., cholesterol; and (iv) a PEG-lipid, in a molar ratio of about 20-60% cationic lipid: 5-25% neutral lipid: 25-55% sterol; 0.5-15% PEG-lipid.

In some embodiments, the inventive mRNA, optionally comprised by the (pharmaceutical) composition or vaccine, may be formulated in an aminoalcohol lipidoid. Aminoalcohol lipidoids which may be used in the present invention may be prepared by the methods described in U.S. Pat. No. 8,450,298, herein incorporated by reference in its entirety. Ionizable lipids can also be the compounds as disclosed in Tables 1, 2 and 3 and claims 1-24 of International Publication No. WO2017/075531 A1, hereby incorporated by reference in its entirety. In another embodiment, ionizable lipids can also be the compounds as disclosed in International Publication No. WO2015/074085 A1 (i.e. ATX-001 to ATX-032 or the compounds as mentioned in claims 1-26), U.S. Appl. Nos. 61/905,724 and Ser. No. 15/614,499 or U.S. Pat. Nos. 9,593,077 and 9,567,296 hereby incorporated by reference in their entirety.

LNPs may include any cationic lipid suitable for forming a lipid nanoparticle. Preferably, the cationic lipid carries a net positive charge at about physiological pH.

The cationic lipid may be an amino lipid. As used herein, the term "amino lipid" is meant to include those lipids having one or two fatty acid or fatty alkyl chains and an amino head group (including an alkylamino or dialkylamino group) that may be protonated to form a cationic lipid at physiological pH.

The cationic lipid may be, for example, N,N—dioleyl—N,N—dimethylammonium chloride (DODAC), N,N—distearyl-N,N—dimethylammonium bromide (DDAB), 1,2-dioleoyltrimethyl ammonium propane chloride (DOTAP) (also known as N—(2,3-dioleoyloxy)propyl]—N,N,N—trimethylammonium chloride and 1,2-Dioleyloxy-3-trimethylaminopropane chloride salt), N—(1-(2,3-dioleyloxy)propyl)—N,N,N—trimethylammonium chloride (DOTMA), N,N—dimethyl-2,3-dioleoyloxy)propylamine (DODMA), 1,2-DiLinoleyloxy-N,N—dimethylaminopropane (DLinDMA), 1,2-Dilinolenyloxy-N,N—dimethylaminopropane (DLenDMA), 1,2-di-γ-linolenyloxy-N,N—dimethylaminopropane (γ-DLenDMA), 1,2-Dilinoleylcarbamoyloxy-3-dimethylaminopropane (DLin-C-DAP), 1,2-Dilinoleyoxy-3-(dimethylamino) acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA·Cl), 1,2-Dilinoleoyl-3-trimethylaminopropane chloride salt (DLin-TAP·Cl), 1,2-Dilinoleyloxy-3-(N—methylpiperazino)propane (DLin-MPZ), or 3-(N,N—Dilinoleylamino)-1,2-propanediol (DLinAP), 3-(N,N—Dioleylamino)-1,2-propanedio (DOAP), 1,2-Dilinoleyloxo-3-(2-N,N—dimethylamino)ethoxypropane (DLin-EG-DM A), 2,2-Dilinoleyl-4-dimethylaminomethyl-[1,3]-dioxolane (DLin-K-DMA) or analogs thereof, (3aR,5s,6aS)—N,N—dimethyl-2,2-di((9Z,12Z)-octadeca-9,12-dienyl)tetrahydro-3aH-cyclopenta[d][1,3]dioxol-5-amine, (6Z,9Z,28Z,31Z)-heptatriaconta-6,9,28,31-tetraen-19-yl 4-(dimethylamino)butanoate (MC3), 1,1'-(2-(4-(2-((2-(bis(2-hydroxydodecyl)amino)ethyl)(2-hydroxydodecyl)amino)ethyDpiperazin-1-yl)ethylazanediyl)didodecan-2-ol (C12-200), 2,2-dilinoleyl-4-(2-dimethylaminoethyl)-[1,3]-dioxolane (DLin-K—C2-DMA), 2,2-dilinoleyl-4-dimethylaminomethyl-[1,3]-dioxolane (DLin-K-DMA), (6Z,9Z,28Z,31Z)-heptatriaconta-6,9,28,31-tetraen-19-yl 4-(dimethylamino)butanoate (DLin-M-C3-DMA), 3-((6Z,9Z,28Z,31Z)-heptatriaconta-6,9,28,31-tetraen-19-yloxy)-N,N—dimethylpropan-1-amine (MC3 Ether), 4-((6Z,9Z,28Z,31Z)-heptatriaconta-6,9,28,31-tetraen-19-yloxy)-N,N—dimethylbutan-1-amine (MC4 Ether), or any combination of any of the foregoing.

Other cationic lipids include, but are not limited to, N,N—distearyl-N,N—dimethylammonium bromide (DDAB), 3P—(N—(N',N'-dimethylaminoethane)-carbamoyl)cholesterol (DC-Choi), N—(1-(2,3-dioleyloxy)propyl)—N—2-(sperminecarboxamido)ethyl)-N,N—dimethylammonium trifluoracetate (DOSPA), dioctadecylamidoglycyl carboxyspermine (DOGS), 1,2-dileoyl-sn-3-phosphoethanolamine (DOPE), 1,2-dioleoyl-3-dimethylammonium propane (DODAP), N—(1,2-dimyristyloxyprop-3-yl)-N,N—dimethyl—N—hydroxyethyl ammonium bromide (DMRIE), and 2,2-Dilinoleyl-4-dimethylaminoethyl-[1,3]-dioxolane (XTC). Additionally, commercial preparations of cationic lipids can be used, such as, e.g., LIPOFECTIN (including DOTMA and DOPE, available from GIBCO/BRL), and LIPOFECTAMINE (comprising DOSPA and DOPE, available from GIBCO/BRL).

Other suitable (cationic) lipids are disclosed in WO2009/086,558, WO2009/127,060, WO2010/048,536, WO2010/054,406, WO2010/088,537, WO2010/129,709, WO2011/153,493, US2011/0256175, US2012/0128760, US2012/0027803, and U.S. Pat. No. 8,158,601. In that context, the disclosures of WO2009/086,558, WO2009/127,060, WO2010/048,536, WO2010/054,406, WO2010/088,537, WO2010/129709, WO2011/153,493, US2011/0256175, US2012/0128760, US2012/0027803, and U.S. Pat. No. 8,158,601 are incorporated herewith by reference.

In some aspects, the lipid is selected from the group consisting of 98N12-5, C12-200, and ckk-E12. The cationic lipid may also be an amino lipid. Suitable amino lipids include those having alternative fatty acid groups and other dialkylamino groups, including those in which the alkyl substituents are different (e.g., N—ethyl—N—methylamino-, and N—propyl—N—ethylamino-). In general, amino lipids having less saturated acyl chains are more easily sized, particularly when the complexes must be sized below about 0.3 microns, for purposes of filter sterilization. Amino lipids containing unsaturated fatty acids with carbon chain lengths in the range of C14 to C22 may be used. Other scaffolds can also be used to separate the amino group and the fatty acid or fatty alkyl portion of the amino lipid.

Representative amino lipids include, but are not limited to, 1,2-dilinoleyoxy-3-(dimethylamino)acetoxypropane (DLin-DAC), 1,2-dilinoleyoxy-3morpholinopropane (DLin-MA), 1,2-dilinoleoyl-3-dimethylaminopropane (DLinDAP), 1,2-dilinoleylthio-3-dimethylaminopropane (DLin-S-DMA), 1-linoleoyl-2-linoleyloxy-3dimethylaminopropane (DLin-2-DMAP), 1,2-dilinoleyloxy-3-trimethylaminopropane chloride salt (DLin-TMA·Cl), 1,2-dilinoleoyl-3-trimethylaminopropane chloride salt (DLin-TAP·Cl), 1,2-dilinoleyloxy-3-(N—methylpiperazino)propane (DLin-MPZ), 3-(N,Ndilinoleylamino)-1,2-propanediol (DLinAP), 3-(N,N—dioleylamino)-1,2-propanediol (DOAP), 1,2-dilinoleyloxo-3-(2-N,N—dimethylamino)ethoxypropane (DLin-EG-DMA), and 2,2-dilinoleyl-4-dimethylaminomethyl-[1,3]-dioxolane (DLin-K-DMA), 2,2-dilinoleyl-4-(2-dimethylaminoethyl)-[1,3]-dioxolane (DLin-KC2-DMA); dilinoleyl-methyl-4-dimethylaminobutyrate (DLin-MC3-DMA); MC3 (US20100324120).

In some embodiments, amino or cationic lipids have at least one protonatable or deprotonatable group, such that the lipid is positively charged at a pH at or below physiological pH (e.g. pH 7.4), and neutral at a second pH, preferably at or above physiological pH. It will, of course, be understood that the addition or removal of protons as a function of pH is an equilibrium process, and that the reference to a charged or a neutral lipid refers to the nature of the predominant species and does not require that all of the lipid be present in the charged or neutral form. Lipids that have more than one protonatable or deprotonatable group, or which are zwitterionic, are not excluded from use in the invention.

In some embodiments, the protonatable lipids have a pKa of the protonatable group in the range of about 4 to about 11, e.g., a pKa of about 5 to about 7.

LNPs can include two or more cationic lipids. The cationic lipids can be selected to contribute different advantageous properties. For example, cationic lipids that differ in properties such as amine pKa, chemical stability, half-life in circulation, half-life in tissue, net accumulation in tissue, or toxicity can be used in the LNP. In particular, the cationic lipids can be chosen so that the properties of the mixed-LNP are more desirable than the properties of a single-LNP of individual lipids.

In some embodiments, the cationic lipid is present in a ratio of from about 20 mol % to about 70 or 75 mol % or from about 45 to about 65 mol % or about 20, 25, 30, 35, 40, 45, 50, 55, 60, 65, or about 70 mol % of the total lipid present in the LNP. In further embodiments, the LNPs comprise from about 25% to about 75% on a molar basis of cationic lipid, e.g., from about 20 to about 70%, from about 35 to about 65%, from about 45 to about 65%, about 60%, about 57.5%, about 57.1%, about 50% or about 40% on a molar basis (based upon 100% total moles of lipid in the lipid nanoparticle). In some embodiments, the ratio of cationic lipid to nucleic acid is from about 3 to about 15, such as from about 5 to about 13 or from about 7 to about 11.

The amount of the permanently cationic lipid or lipidoid may be selected taking the amount of the nucleic acid cargo into account. In one embodiment, these amounts are selected such as to result in an N/P ratio of the nanoparticle(s) or of the composition in the range from about 0.1 to about 20. In this context, the N/P ratio is defined as the mole ratio of the nitrogen atoms ("N") of the basic nitrogen-containing groups of the lipid or lipidoid to the phosphate groups ("P") of the RNA which is used as cargo. The N/P ratio may be calculated on the basis that, for example, 1 µg RNA typically contains about 3 nmol phosphate residues, provided that the RNA exhibits a statistical distribution of bases. The "N"-value of the lipid or lipidoid may be calculated on the basis of its molecular weight and the relative content of permanently cationic and—if present—cationisable groups.

In certain embodiments, the LNP comprises one or more additional lipids which stabilize the formation of particles during their formation.

In some embodiments, non-cationic may be used. The non-cationic lipid can be a neutral lipid, an anionic lipid, or an amphipathic lipid. Neutral lipids, when present, can be any of a number of lipid species which exist either in an uncharged or neutral zwitterionic form at physiological pH. Such lipids include, for example, diacylphosphatidylcholine, diacylphosphatidylethanolamine, ceramide, sphingomyelin, dihydrosphingomyelin, cephalin, and cerebrosides. The selection of neutral lipids for use in the particles described herein is generally guided by consideration of, e.g., LNP size and stability of the LNP in the bloodstream. Preferably, the neutral lipid is a lipid having two acyl groups (e.g., diacylphosphatidylcholine and diacylphosphatidylethanolamine).

In some embodiments, the neutral lipids contain saturated fatty acids with carbon chain lengths in the range of C10 to C20. In other embodiments, neutral lipids with mono or diunsaturated fatty acids with carbon chain lengths in the range of C10 to C20 are used. Additionally, neutral lipids having mixtures of saturated and unsaturated fatty acid chains can be used.

Suitable neutral lipids include, but are not limited to, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), dioleoyl-phosphatidylethanolamine 4-(N—maleimidomethyl)-cyclohexane-1-carboxylate (DOPE-mal), dipalmitoyl phosphatidyl ethanolamine (DPPE), dimyristoylphosphoethanolamine (DMPE), dimyristoyl phosphatidylcholine (DMPC), distearoyl-phosphatidyl-ethanolamine (DSPE), SM, 16-O-monomethyl PE, 16-O-dimethyl PE, 18-1-trans PE, 1-stearoyl-2-oleoyl-phosphatidyethanolamine (SOPE), cholesterol, or a mixture thereof. Anionic lipids suitable for use in LNPs include, but are not limited to, phosphatidylglycerol, cardiolipin, diacylphosphatidylserine, diacylphosphatidic acid, N—dodecanoyl phosphatidylethanoloamine, N—succinyl phosphatidylethanolamine, N—glutaryl phosphatidylethanolamine, lysylphosphatidylglycerol, and other anionic modifying groups joined to neutral lipids.

In one embodiment, the neutral lipid is 1,2-distearoyl-sn-glycero-3phosphocholine (DSPC).

In some embodiments, the LNPs comprise a neutral lipid selected from DSPC, DPPC, DMPC, DOPC, POPC, DOPE and SM. In various embodiments, the molar ratio of the cationic lipid to the neutral lipid ranges from about 2:1 to about 8:1.

Amphipathic lipids refer to any suitable material, wherein the hydrophobic portion of the lipid material orients into a hydrophobic phase, while the hydrophilic portion orients toward the aqueous phase. Such compounds include, but are not limited to, phospholipids, aminolipids, and sphingolipids. Representative phospholipids include sphingomyelin, phosphatidylcholine, phosphatidylethanolamine, phosphatidylserine, phosphatidylinositol, phosphatidic acid, palmitoyloleoyl phosphatidylcholine, lysophosphatidylcholine, lysophosphatidylethanolamine, dipalmitoylphosphatidylcholine, dioleoylphosphatidylcholine, distearoylphosphatidylcholine, or dilinoleoylphosphatidylcholine. Other phosphorus-lacking compounds, such as sphingolipids, glycosphingolipid families, diacylglycerols, and beta-acyloxyacids, can also be used.

In some embodiments, the non-cationic lipid is present in a ratio of from about 5 mol % to about 90 mol %, about 5 mol % to about 10 mol %, about 5, 10, 15, 20, 25, 30, 35, 40, 45, 50, 55, 60, 65, 70, 75, 80, 85, or about 90 mol % of the total lipid present in the LNP.

In some embodiments, LNPs comprise from about 0% to about 15 or 45% on a molar basis of neutral lipid, e.g., from about 3 to about 12% or from about 5 to about 10%. For instance, LNPs may include about 15%, about 10%, about 7.5%, or about 7.1% of neutral lipid on a molar basis (based upon 100% total moles of lipid in the LNP).

In some embodiments, a sterol may be used. The sterol is preferably cholesterol.

The sterol can be present in a ratio of about 10 mol % to about 60 mol % or about 25 mol % to about 40 mol % of the LNP. In some embodiments, the sterol is present in a ratio of about 10, 15, 20, 25, 30, 35, 40, 45, 50, 55, or about 60 mol % of the total lipid present in the LNP. In other embodiments, LNPs comprise from about 5% to about 50% on a molar basis of the sterol, e.g., about 15% to about 45%, about 20% to about 40%, about 48%, about 40%, about 38.5%, about 35%, about 34.4%, about 31.5% or about 31% on a molar basis (based upon 100% total moles of lipid in the LNP).

In some embodiments, an aggregation reducing agent may be employed. The aggregation reducing agent can be a lipid capable of reducing aggregation.

Examples of such lipids include, but are not limited to, polyethylene glycol (PEG)-modified lipids, monosialoganglioside Gml, and polyamide oligomers (PAO) such as those described in U.S. Pat. No. 6,320,017, which is incorporated by reference in its entirety. Other compounds with uncharged, hydrophilic, steric-barrier moieties, which prevent aggregation during formulation, like PEG, Gml or ATTA, can also be coupled to lipids. ATTA-lipids are described, e.g., in U.S. Pat. No. 6,320,017, and PEG-lipid conjugates are described, e.g., in U.S. Pat. Nos. 5,820,873, 5,534,499, 5,885,613, US20150376115A1 and WO2015/199952, each of which is incorporated by reference in its entirety.

The aggregation reducing agent may be, for example, selected from a polyethyleneglycol (PEG)-lipid including, without limitation, a PEG-diacylglycerol (DAG), a PEG-dialkylglycerol, a PEG-dialkyloxypropyl (DAA), a PEG-phospholipid, a PEG-ceramide (Cer), or a mixture thereof (such as PEG-Cer14 or PEG-Cer20). The PEG-DAA conjugate may be, for example, a PEG-dilauryloxypropyl (C12), a PEG-dimyristyloxypropyl (C14), a PEG-dipalmityloxypropyl (C16), or a PEG-distearyloxypropyl (C18). Other pegylated-lipids include, but are not limited to, polyethylene glycol-didimyristoyl glycerol (C14-PEG or PEG-C14, where PEG has an average molecular weight of 2000 Da) (PEG-DMG); (R)-2,3-bis(octadecyloxy)propyl-1-(methoxy poly(ethylene glycol)2000)propylcarbamate) (PEG-DSG); PEG-carbamoyl-1,2-dimyristyloxypropylamine, in which PEG has an average molecular weight of 2000 Da (PEG-cDMA); N—Acetylgalactosamine-((R)-2,3-bis(octadecyloxy)propyl-1-(methoxy poly(ethylene glycol) 2000)propylcarbamate)) (GalNAc-PEG-DSG); mPEG (mw2000)-diastearoylphosphatidyl-ethanolamine (PEG-DSPE); and polyethylene glycol—dipalmitoylglycerol (PEG-DPG).

In some embodiments, the aggregation reducing agent is PEG-DMG. In other embodiments, the aggregation reducing agent is PEG-c-DMA.

In various embodiments, the molar ratio of the cationic lipid to the PEGylated lipid ranges from about 100:1 to about 25:1.

In a preferred embodiment, the composition of LNPs may be influenced by, inter alia, the selection of the cationic lipid component, the degree of cationic lipid saturation, the nature of the PEGylation, the ratio of all components and biophysical parameters such as its size. In one example by Semple et al. (Semple et al. Nature Biotech. 2010 28: 172-176; herein incorporated by reference in its entirety), the LNP composition was composed of 57.1% cationic lipid, 7.1% dipalmitoylphosphatidylcholine, 34.3% cholesterol, and 1.4% PEG-c-DMA (Basha et al. Mol Ther. 2011 19:2186-2200; herein incorporated by reference in its entirety).

In some embodiments, LNPs may comprise from about 35 to about 45% cationic lipid, from about 40% to about 50% cationic lipid, from about 50% to about 60% cationic lipid and/or from about 55% to about 65% cationic lipid. In some embodiments, the ratio of lipid to mRNA may range from about 5:1 to about 20:1, from about 10:1 to about 25:1, from about 15:1 to about 30:1 and/or at least 30:1.

The average molecular weight of the PEG moiety in the PEG-modified lipids can range from about 500 to about 8,000 Daltons (e.g., from about 1,000 to about 4,000 Daltons). In one preferred embodiment, the average molecular weight of the PEG moiety is about 2,000 Daltons.

The concentration of the aggregation reducing agent may range from about 0.1 to about 15 mol %, per 100% total moles of lipid in the LNP. In some embodiments, LNPs include less than about 3, 2, or 1 mole percent of PEG or PEG-modified lipid, based on the total moles of lipid in the LNP. In further embodiments, LNPs comprise from about 0.1% to about 20% of the PEG-modified lipid on a molar basis, e.g., about 0.5 to about 10%, about 0.5 to about 5%, about 10%, about 5%, about 3.5%, about 3%, about 2.5%, about 2%, about 1.5%, about 1%, about 0.5%, or about 0.3% on a molar basis (based on 100% total moles of lipids in the LNP).

Different LNPs having varying molar ratios of cationic lipid, non-cationic (or neutral) lipid, sterol (e.g., cholesterol), and aggregation reducing agent (such as a PEG-modified lipid) on a molar basis (based upon the total moles of lipid in the lipid nanoparticles) as depicted in Table 6 below:

TABLE 6

Lipid-based formulations

Molar Ratio of Lipids
(Based upon 100% total moles of lipid in the lipid nanoparticle)

| Formulation No. | Cationic Lipid | Non-Cationic (or Neutral) Lipid | Sterol | Aggregation Reducing Agent (e.g., PEG-lipid) |
|---|---|---|---|---|
| 1 | from about 35 to about 65% | from about 3 to about 12 or 15% | from about 15 to about 45% | from about 0.1 to about 10% (preferably from about 0.5 to about 2 or 3%) |
| 2 | from about 20 to about 70% | from about 5 to about 45% | from about 20 to about 55% | from about 0.1 to about 10% (preferably from about 0.5 to about 2 or 3%) |
| 3 | from about 45 to about 65% | from about 5 to about 10% | from about 25 to about 40% | from about 0.1 to about 3% |
| 4 | from about 20 to about 60% | from about 5 to about 25% | from about 25 to about 55% | from about 0.1 to about 5% (preferably from about 0.1 to about 3%) |
| 5 | about 40% | about 10% | about 40% | about 10% |
| 6 | about 35% | about 15% | about 40% | about 10% |
| 7 | about 52% | about 13% | about 30% | about 5% |
| 8 | about 50% | about 10% | about 38.5% | about 1.5% |

The total amount of nucleic acid, particularly the RNA in the lipid nanoparticles varies and may be defined depending on the e.g. RNA to total lipid w/w ratio. In one embodiment of the invention the RNA to total lipid ratio is less than 0.06 w/w, preferably between 0.03 w/w and 0.04 w/w.

In some embodiments, LNPs occur as liposomes or lipoplexes as described in further detail below.

In some embodiments, LNPs have a median diameter size of from about 50 nm to about 300 nm, such as from about 50 nm to about 250 nm, for example, from about 50 nm to about 200 nm.

In some embodiments, smaller LNPs may be used. Such particles may comprise a diameter from below 0.1 µm up to 100 nm such as, but not limited to, less than 0.1 µm, less than 1.0 µm, less than 5 µm, less than 10 µm, less than 15 µm, less than 20 µm, less than 25 µm, less than 30 µm, less than 35 µm, less than 40 µm, less than 50 µm, less than 55 µm, less than 60 µm, less than 65 µm, less than 70 µm, less than 75 µm, less than 80 µm, less than 85 µm, less than 90 µm, less than 95 µm, less than 100 µm, less than 125 µm, less than 150 µm, less than 175 µm, less than 200 µm, less than 225 µm, less than 250 µm, less than 275 µm, less than 300 µm, less than 325 µm, less than 350 µm, less than 375 µm, less than 400 µm, less than 425 µm, less than 450 µm, less than 475 µm, less than 500 µm, less than 525 µm, less than 550 µm, less than 575 µm, less than 600 µm, less than 625 µm, less than 650 µm, less than 675 µm, less than 700 µm, less than 725 µm, less than 750 µm, less than 775 µm, less than 800 µm, less than 825 µm, less than 850 µm, less than 875 µm, less than 900 µm, less than 925 µm, less than 950 µm, less than 975 µm. In another embodiment, nucleic acids may be delivered using smaller LNPs which may comprise a diameter from about 1 nm to about 100 nm, from about 1 nm to about 10 nm, about 1 nm to about 20 nm, from about 1 nm to about 30 nm, from about 1 nm to about 40 nm, from about 1 nm to about 50 nm, from about 1 nm to about 60 nm, from about 1 nm to about 70 nm, from about 1 nm to about 80 nm, from about 1 nm to about 90 nm, from about 5 nm to about from 100 nm, from about 5 nm to about 10 nm, about 5 nm to about 20 nm, from about 5 nm to about 30 nm, from about 5 nm to about 40 nm, from about 5 nm to about 50 nm, from about 5 nm to about 60 nm, from about 5 nm to about 70 nm, from about 5 nm to about 80 nm, from about 5 nm to about 90 nm, about 10 to about 50 nm, from about 20 to about 50 nm, from about 30 to about 50 nm, from about 40 to about 50 nm, from about 20 to about 60 nm, from about 30 to about 60 nm, from about 40 to about 60 nm, from about 20 to about 70 nm, from about 30 to about 70 nm, from about 40 to about 70 nm, from about 50 to about 70 nm, from about 60 to about 70 nm, from about 20 to about 80 nm, from about 30 to about 80 nm, from about 40 to about 80 nm, from about 50 to about 80 nm, from about 60 to about 80 nm, from about 20 to about 90 nm, from about 30 to about 90 nm, from about 40 to about 90 nm, from about 50 to about 90 nm, from about 60 to about 90 nm and/or from about 70 to about 90 nm.

In some embodiments, the LNP may have a diameter greater than 100 nm, greater than 150 nm, greater than 200 nm, greater than 250 nm, greater than 300 nm, greater than 350 nm, greater than 400 nm, greater than 450 nm, greater than 500 nm, greater than 550 nm, greater than 600 nm, greater than 650 nm, greater than 700 nm, greater than 750 nm, greater than 800 nm, greater than 850 nm, greater than 900 nm, greater than 950 nm or greater than 1000 nm.

In other embodiments, LNPs have a single mode particle size distribution (i.e., they are not bi- or poly-modal).

LNPs as used herein may further comprise one or more lipids and/or other components in addition to those mentioned above.

Other lipids may be included in the liposome compositions for a variety of purposes, such as to prevent lipid oxidation or to attach ligands onto the liposome surface. Any of a number of lipids may be present in LNPs, including amphipathic, neutral, cationic, and anionic lipids. Such lipids can be used alone or in combination.

Additional components that may be present in a LNP include bilayer stabilizing components such as polyamide oligomers (see, e.g., U.S. Pat. No. 6,320,017, which is incorporated by reference in its entirety), peptides, proteins, and detergents.

In some embodiments, the inventive mRNAs, optionally comprised by (pharmaceutical) compositions or vaccines are formulated as liposomes.

Cationic lipid-based liposomes are able to complex with negatively charged nucleic acids (e.g. mRNAs) via electrostatic interactions, resulting in complexes that offer biocompatibility, low toxicity, and the possibility of the large-scale production required for in vivo clinical applications. Liposomes can fuse with the plasma membrane for uptake; once inside the cell, the liposomes are processed via the endocytic pathway and the nucleic acid is then released from the endosome/carrier into the cytoplasm. Liposomes have long been perceived as drug delivery vehicles because of their superior biocompatibility, given that liposomes are basically analogs of biological membranes, and can be prepared from both natural and synthetic phospholipids (Int J Nanomedicine. 2014; 9: 1833-1843).

Liposomes typically consist of a lipid bilayer that can be composed of cationic, anionic, or neutral (phospho)lipids and cholesterol, which encloses an aqueous core. Both the lipid bilayer and the aqueous space can incorporate hydrophobic or hydrophilic compounds, respectively. Liposomes may have one or more lipid membranes. Liposomes can be single-layered, referred to as unilamellar, or multi-layered, referred to as multilamellar.

Liposome characteristics and behaviour in vivo can be modified by addition of a hydrophilic polymer coating, e.g. polyethylene glycol (PEG), to the liposome surface to confer steric stabilization. Furthermore, liposomes can be used for specific targeting by attaching ligands (e.g., antibodies, peptides, and carbohydrates) to its surface or to the terminal end of the attached PEG chains (Front Pharmacol. 2015 Dec. 1; 6:286).

Liposomes are typically present as spherical vesicles and can range in size from 20 nm to a few microns.

Liposomes can be of different sizes such as, but not limited to, a multilamellar vesicle (MLV) which may be hundreds of nanometers in diameter and may contain a series of concentric bilayers separated by narrow aqueous compartments, a small unicellular vesicle (SUV) which may be smaller than 50 nm in diameter, and a large unilamellar vesicle (LUV) which may be between 50 and 500 nm in diameter. Liposome design may include, but is not limited to, opsonins or ligands in order to improve the attachment of liposomes to unhealthy tissue or to activate events such as, but not limited to, endocytosis. Liposomes may contain a low or a high pH in order to improve the delivery of the pharmaceutical formulations.

As a non-limiting example, liposomes such as synthetic membrane vesicles may be prepared by the methods, apparatus and devices described in US Patent Publication No. US20130177638, US20130177637, US20130177636, US20130177635, US20130177634, US20130177633, US20130183375, US20130183373 and US20130183372, the contents of each of which are herein incorporated by reference in its entirety. The inventive mRNA, optionally comprised by the (pharmaceutical) composition or vaccine, may be encapsulated by the liposome and/or it may be contained in an aqueous core which may then be encapsulated by the liposome (see International Pub. Nos. WO2012/031046, WO2012/031043, WO2012/030901 and WO2012/006378 and US Patent Publication No. US20130189351, US20130195969 and US20130202684; the contents of each of which are herein incorporated by reference in their entirety).

In some embodiments, the inventive mRNA, optionally comprised by the (pharmaceutical) composition or vaccine, may be formulated in liposomes such as, but not limited to, DiLa2 liposomes (Marina Biotech, Bothell, Wash.), SMARTICLES® (Marina Biotech, Bothell, Wash.), neutral DOPC (1,2-dioleoyl-sn-glycero-3-phosphocholine) based liposomes (e.g., siRNA delivery for ovarian cancer (Landen et al. Cancer Biology & Therapy 2006 5(12)1708-1713); herein incorporated by reference in its entirety) and hyaluronan-coated liposomes (Quiet Therapeutics, Israel).

In some embodiments, the inventive mRNA, optionally comprised by the (pharmaceutical) composition or vaccine, is formulated in the form of lipoplexes, i.e. cationic lipid bilayers sandwiched between nucleic acid (e.g. mRNA) layers.

Cationic lipids, such as DOTAP, (1,2-dioleoyl-3-trimethylammonium-propane) and DOTMA (N—[1-(2,3-dioleoyloxy)propyl]—N,N,N—trimethyl-ammonium methyl sulfate) can form complexes or lipoplexes with negatively charged nucleic acids to form nanoparticles by electrostatic interaction, providing high in vitro transfection efficiency.

In some embodiments, the inventive mRNA, optionally comprised by the (pharmaceutical) composition or vaccine as defined herein, is formulated in the form of nanoliposomes, preferably neutral lipid-based nanoliposomes such as 1,2-dioleoyl-sn-glycero-3-phosphatidylcholine (DOPC)-based nanoliposomes (Adv Drug Deliv Rev. 2014 February; 66: 110-116.).

In some embodiments, the inventive mRNA, optionally comprised by the (pharmaceutical) composition or vaccine as defined herein, is provided in the form of an emulsion. In some embodiment, said mRNA is formulated in a cationic oil-in-water emulsion, wherein the emulsion particle comprises an oil core and a cationic lipid which can interact with said mRNA, anchoring the molecule to the emulsion particle (see International Pub. No. WO2012/006380; herein incorporated by reference in its entirety). In some embodiments, said mRNA is formulated in a water-in-oil emulsion comprising a continuous hydrophobic phase in which the hydrophilic phase is dispersed. As a non-limiting example, the emulsion may be made by the methods described in International Publication No. WO2010/87791, the contents of which are herein incorporated by reference in its entirety.

In a preferred embodiment, the composition according to the invention comprises at least one mRNA according to the invention that is formulated together with a cationic or polycationic compound and/or with a polymeric carrier. Accordingly, in a further embodiment of the invention, it is preferred that the mRNA as defined herein or any other nucleic acid comprised in the inventive (pharmaceutical) composition or vaccine is associated with or complexed with a cationic or polycationic compound or a polymeric carrier, optionally in a weight ratio selected from a range of about 6:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w) of mRNA or nucleic acid to cationic or polycationic compound and/or with a polymeric carrier; or optionally in a nitrogen/phosphate (N/P) ratio of mRNA or nucleic acid to cationic or polycationic compound and/or polymeric carrier in the range of about 0.1-10, preferably in a range of about 0.3-4 or 0.3-1, and most preferably in a range of about 0.5-1 or 0.7-1, and even most preferably in a range of about 0.3-0.9 or 0.5-0.9. More preferably, the N/P ratio of the at least one mRNA to the one or more polycations is in the range of about 0.1 to 10, including a range of about 0.3 to 4, of about 0.5 to 2, of about 0.7 to 2 and of about 0.7 to 1.5.

Therein, the mRNA as defined herein or any other nucleic acid comprised in the (pharmaceutical) composition or vaccine according to the invention can also be associated with a vehicle, transfection or complexation agent for increasing the transfection efficiency and/or the immunostimulatory properties of the mRNA according to the invention or of optionally comprised further included nucleic acids.

Cationic or polycationic compounds, being particularly preferred agents in this context include protamine, nucleoline, spermine or spermidine, or other cationic peptides or proteins, such as poly-L-lysine (PLL), poly-arginine, basic polypeptides, cell penetrating peptides (CPPs), including HIV-binding peptides, HIV-1 Tat (HIV), Tat-derived peptides, Penetratin, VP22 derived or analog peptides, HSV VP22 (Herpes simplex), MAP, KALA or protein transduction domains (PTDs), PpT620, prolin-rich peptides, arginine-rich peptides, lysine-rich peptides, MPG-peptide(s), Pep-1, L-oligomers, Calcitonin peptide(s), Antennapedia-derived peptides (particularly from *Drosophila antennapedia*), pAntp, pIsl, FGF, Lactoferrin, Transportan, Buforin-2, Bac715-24, SynB, SynB(1), pVEC, hCT-derived peptides, SAP, or histones. More preferably, the mRNA according to the invention is complexed with one or more polycations, preferably with protamine or oligofectamine, most preferably with protamine. In this context protamine is particularly preferred.

Additionally, preferred cationic or polycationic proteins or peptides may be selected from the following proteins or peptides having the following total formula (III):

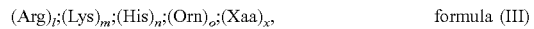

$(Arg)_l;(Lys)_m;(His)_n;(Orn)_o;(Xaa)_x,$      formula (III)

wherein l+m+n+o+x=8-15, and l, m, n or o independently of each other may be any number selected from 0, 1, 2, 3, 4, 5, 6, 7, 8, 9, 10, 11, 12, 13, 14 or 15, provided that the overall content of Arg, Lys, His and Orn represents at least 50% of all amino acids of the oligopeptide; and Xaa may be any amino acid selected from native (=naturally occurring) or non-native amino acids except of Arg, Lys, His or Orn; and x may be any number selected from 0, 1, 2, 3 or 4, provided, that the overall content of Xaa does not exceed 50% of all amino acids of the oligopeptide. Particularly preferred cationic peptides in this context are e.g. Arg7, Arg8, Arg9, H3R9, R9H3, H3R9H3, YSSR9SSY, (RKH)4, Y(RKH)2R, etc. In this context the disclosure of WO2009/030481 is incorporated herewith by reference.

Preferred cationic or polycationic proteins or peptides may be derived from formula $Cys\{(Arg)_l;(Lys)_m;(His)_n;(Orn)_o;(Xaa)_x\}Cys$ or $\{(Arg)_l;(Lys)_m;(His)_n;(Orn)_o;(Xaa)_x\}$ of the patent application WO2009/030,481 or WO2011/026,641, the disclosure of WO2009/030,481 and WO2011/026,641 relating thereto are incorporated herewith by reference. In a preferred embodiment, the cationic or polycationic proteins or peptides comprises CHHHHHHRRR- RHHHHHHC (SEQ ID NO: 1443), CR12C (SEQ ID NO: 1440), CR12 (SEQ ID NO: 1441) or WR12C (SEQ ID NO: 1442).

Further preferred cationic or polycationic compounds, which can be used as transfection or complexation agent may include cationic polysaccharides, for example chitosan, polybrene, cationic polymers, e.g. polyethyleneimine (PEI), cationic lipids, e.g. DOTMA: [1-(2,3-sioleyloxy)propyl)]—N,N,N—trimethylammonium chloride, DMRIE, di-C14-amidine, DOTIM, SAINT, DC-Chol, BGTC, CTAP, DOPC, DODAP, DOPE: Dioleyl phosphatidylethanol-amine, DOSPA, DODAB, DOIC, DMEPC, DOGS: Dioctadecy-lamidoglicylspermin, DIMRI: Dimyristo-oxypropyl dimethyl hydroxyethyl ammonium bromide, DOTAP: dioleoyloxy-3-(trimethylammonio)propane, DC-6-14: O,O-ditetradecanoyl—N—(α-trimethylammonioacetyl) diethanolamine chloride, CLIP1: rac-[(2,3-dioctadecyloxypropyl)(2-hydroxyethyl)]-dimethylammonium chloride, CLIP6: rac-[2(2,3-dihexadecyloxypropyl-oxymethyloxy)ethyl] trimethylammonium, CLIP9: rac-[2(2,3-dihexadecyloxypropyl-oxysuccinyloxy)ethyl]-trimethylammonium, oligofectamine, or cationic or polycationic polymers, e.g. modified polyaminoacids, such as O-aminoacid-polymers or reversed polyamides, etc., modified polyethylenes, such as PVP (poly(N—ethyl-4-vinylpyridinium bromide)), etc., modified acrylates, such as pDMAEMA (poly(dimethylaminoethyl methylacrylate)), etc., modified amidoamines such as pAMAM (poly(amidoamine)), etc., modified polybetaaminoester (PBAE), such as diamine end modified 1,4 butanediol diacrylate-co-5-amino-1-pentanol polymers, etc., dendrimers, such as polypropylamine dendrimers or pAMAM based dendrimers, etc., polyimine(s), such as PEI: poly(ethyleneimine), poly(propyleneimine), etc., polyallylamine, sugar backbone based polymers, such as cyclodextrin based polymers, dextran based polymers, chitosan, etc., silan backbone based polymers, such as PMOXA-PDMS copolymers, etc., blockpolymers consisting of a combination of one or more cationic blocks (e.g. selected from a cationic polymer as mentioned above) and of one or more hydrophilic or hydrophobic blocks (e.g. polyethyleneglycole); etc.

According to a preferred embodiment, the composition of the present invention comprises the mRNA as defined herein and a polymeric carrier. A polymeric carrier used according to the invention might be a polymeric carrier formed by disulfide-crosslinked cationic components. The disulfide-crosslinked cationic components may be the same or different from each other. The polymeric carrier can also contain further components. It is also particularly preferred that the polymeric carrier used according to the present invention comprises mixtures of cationic peptides, proteins or polymers and optionally further components as defined herein, which are crosslinked by disulfide bonds as described herein. In this context, the disclosure of WO2012/013326 is incorporated herewith by reference.

In this context, the cationic components, which form basis for the polymeric carrier by disulfide-crosslinkage, are typically selected from any suitable cationic or polycationic peptide, protein or polymer suitable for this purpose, particular any cationic or polycationic peptide, protein or polymer capable of complexing the mRNA as defined herein or a further nucleic acid comprised in the composition, and thereby preferably condensing the mRNA or the nucleic acid. The cationic or polycationic peptide, protein or polymer, is preferably a linear molecule, however, branched cationic or polycationic peptides, proteins or polymers may also be used.

Every disulfide-crosslinking cationic or polycationic protein, peptide or polymer of the polymeric carrier, which may be used to complex the mRNA according to the invention or any further nucleic acid comprised in the (pharmaceutical) composition or vaccine of the present invention contains at least one —SH moiety, most preferably at least one cysteine residue or any further chemical group exhibiting an —SH moiety, capable of forming a disulfide linkage upon condensation with at least one further cationic or polycationic protein, peptide or polymer as cationic component of the polymeric carrier as mentioned herein.

As defined above, the polymeric carrier, which may be used to complex the mRNA of the present invention or any further nucleic acid comprised in the (pharmaceutical) composition or vaccine according to the invention may be formed by disulfide-crosslinked cationic (or polycationic) components. Preferably, such cationic or polycationic peptides or proteins or polymers of the polymeric carrier, which comprise or are additionally modified to comprise at least one —SH moiety, are selected from, proteins, peptides and polymers as defined herein for complexation agent.

In a further particular embodiment, the polymeric carrier which may be used to complex the (m)RNA as defined herein or any further nucleic acid comprised in the (pharmaceutical) composition or vaccine according to the invention may be selected from a polymeric carrier molecule according to generic formula (IV):

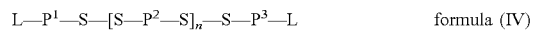  formula (IV)

wherein, $P^1$ and $P^3$ are different or identical to each other and represent a linear or branched hydrophilic polymer chain, each $P^1$ and $P^3$ exhibiting at least one —SH-moiety, capable to form a disulfide linkage upon condensation with component $P^2$, or alternatively with (AA), $(AA)_x$, or $[(AA)_x]_z$ if such components are used as a linker between $P^1$ and $P^2$ or $P^3$ and $P^2$) and/or with further components (e.g. (AA), $(AA)_x$, $[(AA)_x]_z$ or L), the linear or branched hydrophilic polymer chain selected independent from each other from polyethylene glycol (PEG), poly—N—(2-hydroxypropyl)methacrylamide, poly-2-(methacryloyloxy)ethyl phosphorylcholines, poly(hydroxyalkyl L-asparagine), poly(2-(methacryloyloxy)ethyl phosphorylcholine), hydroxyethylstarch or poly(hydroxyalkyl L-glutamine), wherein the hydrophilic polymer chain exhibits a molecular weight of about 1 kDa to about 100 kDa, preferably of about 2 kDa to about 25 kDa; or more preferably of about 2 kDa to about 10 kDa, e.g. about 5 kDa to about 25 kDa or 5 kDa to about 10 kDa;

$P^2$ is a cationic or polycationic peptide or protein, e.g. as defined above for the polymeric carrier formed by disulfide-crosslinked cationic components, and preferably having a length of about 3 to about 100 amino acids, more preferably having a length of about 3 to about 50 amino acids, even more preferably having a length of about 3 to about 25 amino acids, e.g. a length of about 3 to 10, 5 to 15, 10 to 20 or 15 to 25 amino acids, more preferably a length of about 5 to about 20 and even more preferably a length of about 10 to about 20; or is a cationic or polycationic polymer, e.g. as defined above for the polymeric carrier formed by disulfide-crosslinked cationic components, typically having a molecular weight of about 0.5 kDa to about 30 kDa, including a molecular weight of about 1 kDa to about 20 kDa, even more preferably of about 1.5 kDa to about 10 kDa, or having a molecular weight of about 0.5 kDa to about 100 kDa, including a molecular weight of about 10 kDa to about 50 kDa, even more preferably of about 10 kDa to about 30 kDa;

each $P^2$ exhibiting at least two —SH-moieties, capable to form a disulfide linkage upon condensation with further components $P^2$ or component(s) $P^1$ and/or $P^3$ or alternatively with further components (e.g. (AA), (AA)$_x$, or [(AA)$_x$]$_z$);

—S—S— is a (reversible) disulfide bond (the brackets are omitted for better readability), wherein S preferably represents sulphur or a —SH carrying moiety, which has formed a (reversible) disulfide bond. The (reversible) disulfide bond is preferably formed by condensation of —SH-moieties of either components $P^1$ and $P^2$, $P^2$ and $P^2$, or $P^2$ and $P^3$, or optionally of further components as defined herein (e.g. L, (AA), (AA)$_x$, [(AA)$_x$]$_z$, etc.); The —SH-moiety may be part of the structure of these components or added by a modification as defined below;

L is an optional ligand, which may be present or not, and may be selected independent from the other from RGD, Transferrin, Folate, a signal peptide or signal sequence, a localization signal or sequence, a nuclear localization signal or sequence (NLS), an antibody, a cell penetrating peptide, (e.g. TAT or KALA), a ligand of a receptor (e.g. cytokines, hormones, growth factors etc.), small molecules (e.g. carbohydrates like mannose or galactose or synthetic ligands), small molecule agonists, inhibitors or antagonists of receptors (e.g. RGD peptidomimetic analogues), or any further protein as defined herein, etc.;

n is an integer, typically selected from a range of about 1 to 50, preferably from a range of about 1, 2 or 3 to 30, more preferably from a range of about 1, 2, 3, 4, or 5 to 25, or a range of about 1, 2, 3, 4, or 5 to 20, or a range of about 1, 2, 3, 4, or 5 to 15, or a range of about 1, 2, 3, 4, or 5 to 10, including e.g. a range of about 4 to 9, 4 to 10, 3 to 20, 4 to 20, 5 to 20, or 10 to 20, or a range of about 3 to 15, 4 to 15, 5 to 15, or 10 to 15, or a range of about 6 to 11 or 7 to 10. Most preferably, n is in a range of about 1, 2, 3, 4, or 5 to 10, more preferably in a range of about 1, 2, 3, or 4 to 9, in a range of about 1, 2, 3, or 4 to 8, or in a range of about 1, 2, or 3 to 7.

In this context, the disclosure of WO2011/026641 is incorporated herewith by reference. Each of hydrophilic polymers P1 and P3 typically exhibits at least one —SH-moiety, wherein the at least one —SH-moiety is capable to form a disulfide linkage upon reaction with component P2 or with component (AA) or (AA)x, if used as linker between P1 and P2 or P3 and P2 as defined below and optionally with a further component, e.g. L and/or (AA) or (AA)x, e.g. if two or more —SH-moieties are contained. The following subformulae "P1—S—S—P2" and "P2—S—S—P3" within generic formula (IV) above (the brackets are omitted for better readability), wherein any of S, P1 and P3 are as defined herein, typically represent a situation, wherein one —SH-moiety of hydrophilic polymers P1 and P3 was condensed with one —SH-moiety of component P2 of generic formula (IV) above, wherein both sulphurs of these —SH-moieties form a disulfide bond —S—S— as defined herein in formula (IV). These —SH-moieties are typically provided by each of the hydrophilic polymers P1 and P3, e.g. via an internal cysteine or any further (modified) amino acid or compound which carries a —SH moiety. Accordingly, the subformulae "P1—S—S—P2" and "P2—S—S—P3" may also be written as "P1—Cys—Cys—P2" and "P2—Cys—Cys—P3", if the —SH— moiety is provided by a cysteine, wherein the term "Cys—Cys" represents two cysteines coupled via a disulfide bond, not via a peptide bond. In this case, the term "—S—S—" in these formulae may also be written as "—S—Cys", as "—Cys—S" or as "—Cys—Cys-". In this context, the term "—Cys—Cys-" does not represent a peptide bond but a linkage of two cysteines via their —SH-moieties to form a disulfide bond. Accordingly, the term "—Cys—Cys-" also may be understood generally as "—(Cys—S)—(S—Cys)—", wherein in this specific case S indicates the sulphur of the —SH-moiety of cysteine. Likewise, the terms "—S—Cys" and "—Cys—S" indicate a disulfide bond between a —SH containing moiety and a cysteine, which may also be written as "—S—(S—Cys)" and "—(Cys—S)—S". Alternatively, the hydrophilic polymers P1 and P3 may be modified with a —SH moiety, preferably via a chemical reaction with a compound carrying a —SH moiety, such that each of the hydrophilic polymers P1 and P3 carries at least one such —SH moiety. Such a compound carrying a —SH moiety may be e.g. an (additional) cysteine or any further (modified) amino acid, which carries a —SH moiety. Such a compound may also be any non-amino compound or moiety, which contains or allows to introduce a —SH moiety into hydrophilic polymers P1 and P3 as defined herein. Such non-amino compounds may be attached to the hydrophilic polymers P1 and P3 of formula (IV) of the polymeric carrier according to the present invention via chemical reactions or binding of compounds, e.g. by binding of a 3-thio propionic acid or thioimolane, by amide formation (e.g. carboxylic acids, sulphonic acids, amines, etc), by Michael addition (e.g maleinimide moieties, α,β-unsatured carbonyls, etc), by click chemistry (e.g. azides or alkines), by alkene/alkine methatesis (e.g. alkenes or alkines), imine or hydrozone formation (aldehydes or ketons, hydrazins, hydroxylamins, amines), complexation reactions (avidin, biotin, protein G) or components which allow Sn-type substitution reactions (e.g halogenalkans, thiols, alcohols, amines, hydrazines, hydrazides, sulphonic acid esters, oxyphosphonium salts) or other chemical moieties which can be utilized in the attachment of further components. A particularly preferred PEG derivate in this context is alpha-Methoxy-omega-mercapto poly(ethylene glycol). In each case, the SH-moiety, e.g. of a cysteine or of any further (modified) amino acid or compound, may be present at the terminal ends or internally at any position of hydrophilic polymers P1 and P3. As defined herein, each of hydrophilic polymers P1 and P3 typically exhibits at least one —SH-moiety preferably at one terminal end, but may also contain two or even more —SH-moieties, which may be used to additionally attach further components as defined herein, preferably further functional peptides or proteins e.g. a ligand, an amino acid component (AA) or (AA)x, antibodies, cell penetrating peptides or enhancer peptides (e.g. TAT, KALA), etc.

In a particularly preferred embodiment, the polymeric carrier is a peptide polymer, preferably a polyethylene glycol/peptide polymer comprising HO-PEG5000—S—(S—CHHHHRRRRHHHHHC—S—)7—S—PEG5000—

OH (peptide component: SEQ ID NO: 1443 and a lipid component, preferably a lipidoid component, more preferably lipidoid 3-C12—OH.

The lipidoid 3-C12—OH

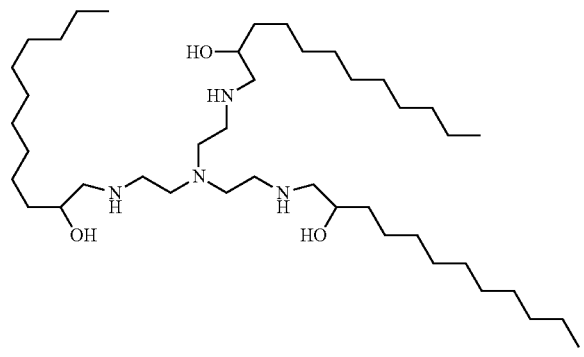 [SMILES: CCCCCCCCCCC(O)CNCCN(CCNCC(O)CCCCCCCCCC)CCNCC(O)CCCCCCCCCC]

(as shown above) may be obtained by acylation of tris(2-aminoethyl)amine with an activated lauric (C12) acid derivative, followed by reduction of the amide. Alternatively, it may be prepared by reductive amination with the corresponding aldehyde. Lipidoid 3-C12—OH is prepared by addition of the terminal C12 alkyl epoxide with the same oligoimine according to Love et al., pp. 1864-1869, PNAS, vol. 107 (2010), no. 5 (cf. compound C12 and compound 110 in FIG. 1 of Love et al.). In preferred embodiments, the peptide polymer comprising lipidoid 3-C12—OH as specified above is used to complex the artificial nucleic acid of the invention, in particular RNA, to form complexes having an N/P ratio from about 0.1 to about 20, or from about 0.2 to about 15, or from about 2 to about 15, or from about 2 to about 12, wherein the N/P ratio is defined as the mole ratio of the nitrogen atoms of the basic groups of the cationic peptide or polymer to the phosphate groups of the artificial nucleic acid.

In another embodiment, the polymeric carrier comprises a lipidoid compound according to formula Va

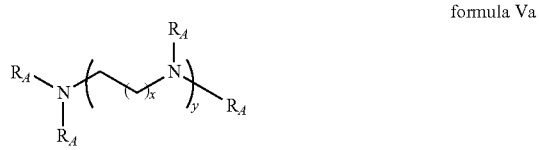
formula Va wherein
RA is independently selected for each occurrence an unsubstituted, cyclic or acyclic, branched or unbranched C1-20 aliphatic group; a substituted or unsubstituted, cyclic or acyclic, branched or unbranched C1-20 heteroaliphatic group; a substituted or unsubstituted aryl; a substituted or unsubstituted heteroaryl;

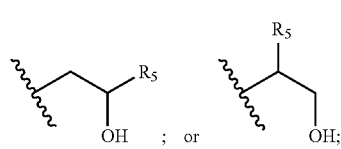

wherein at least one RA is

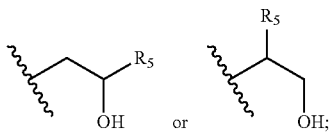

$R_5$ is independently selected for each occurrence of from an unsubstituted, cyclic or acyclic, branched or unbranched C8-16 aliphatic; a substituted or unsubstituted aryl; or a substituted or unsubstituted heteroaryl;
each occurrence of x is an integer from 1 to 10;
each occurrence of y is an integer from 1 to 10;
or a pharmaceutically acceptable salt thereof.

In that context, the disclosure of the PCT patent application PCT/EP2017/064,059 is herewith incorporated by reference.

In other embodiments, the composition, which is preferably a (pharmaceutical) composition comprises at least one artificial nucleic acid as described herein, wherein the at least one artificial nucleic acid is complexed or associated with polymeric carriers and, optionally, with at least one lipid component as described in the PCT applications PCT/EP2017/064,065, PCT/EP2017/064,058. In this context, the disclosures of PCT/EP2017/064,065, and PCT/EP2017/064,058 is herewith incorporated by reference.

Preferably, the inventive composition comprises at least one mRNA as defined herein, which is complexed with one or more polycations, and at least one free mRNA, wherein the at least one complexed mRNA is preferably identical to the at least one free mRNA. In this context, it is particularly preferred that the composition of the present invention comprises the mRNA according to the invention that is complexed at least partially with a cationic or polycationic compound and/or a polymeric carrier, preferably cationic proteins or peptides. In this context, the disclosure of WO2010/037539 and WO2012/113513 is incorporated herewith by reference. Partially means that only a part of the mRNA as defined herein is complexed in the composition according to the invention with a cationic compound and that the rest of the mRNA as defined herein is (comprised in the inventive (pharmaceutical) composition or vaccine) in uncomplexed form ("free"). Preferably, the molar ratio of the complexed mRNA to the free mRNA is selected from a molar ratio of about 0.001:1 to about 1:0.001, including a ratio of about 1:1. More preferably the ratio of complexed mRNA to free mRNA (in the (pharmaceutical) composition or vaccine of the present invention) is selected from a range of about 5:1 (w/w) to about 1:10 (w/w), more preferably from a range of about 4:1 (w/w) to about 1:8 (w/w), even more preferably from a range of about 3:1 (w/w) to about 1:5 (w/w) or 1:3 (w/w), and most preferably the ratio of complexed mRNA to free mRNA in the inventive pharmaceutical composition or vaccine is selected from a ratio of about 1:1 (w/w).

The complexed mRNA in the (pharmaceutical) composition or vaccine according to the present invention, is preferably prepared according to a first step by complexing the mRNA according to the invention with a cationic or polycationic compound and/or with a polymeric carrier, preferably as defined herein, in a specific ratio to form a stable complex. In this context, it is highly preferable, that no free cationic or polycationic compound or polymeric carrier or only a negligibly small amount thereof remains in the component of the complexed mRNA after complexing the mRNA. Accordingly, the ratio of the mRNA and the cationic or polycationic compound and/or the polymeric carrier in the component of the complexed RNA is typically selected in a range so that the mRNA is entirely complexed and no free cationic or polycationic compound or polymeric carrier or only a negligibly small amount thereof remains in the composition.

Preferably the ratio of the mRNA as defined herein to the cationic or polycationic compound and/or the polymeric carrier, preferably as defined herein, is selected from a range of about 6:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w). Alternatively, the ratio of the mRNA as defined herein to the cationic or polycationic compound and/or the polymeric carrier, preferably as defined herein, in the component of the complexed mRNA, may also be calculated on the basis of the nitrogen/phosphate ratio (N/P—ratio) of the entire complex. In the context of the present invention, an N/P—ratio is preferably in the range of about 0.1-10, preferably in a range of about 0.3-4 and most preferably in a range of about 0.5-2 or 0.7-2 regarding the ratio of mRNA:cationic or polycationic compound and/or polymeric carrier, preferably as defined herein, in the complex, and most preferably in a range of about 0.7-1.5, 0.5-1 or 0.7-1, and even most preferably in a range of about 0.3-0.9 or 0.5-0.9, preferably provided that the cationic or polycationic compound in the complex is a cationic or polycationic cationic or polycationic protein or peptide and/or the polymeric carrier as defined above. In this specific embodiment the complexed mRNA as defined herein is also encompassed in the term "adjuvant component".

In other embodiments, the composition according to the invention comprising the mRNA as defined herein may be administered naked without being associated with any further vehicle, transfection or complexation agent.

It has to be understood and recognized, that according to the present invention, the inventive composition may comprise at least one naked mRNA as defined herein and/or at least one formulated/complexed mRNA as defined herein, wherein every formulation and/or complexation as disclosed above may be used.

Adjuvants:

According to another embodiment, the (pharmaceutical) composition or vaccine according to the invention may comprise an adjuvant, which is preferably added in order to enhance the immunostimulatory properties of the composition. In this context, an adjuvant may be understood as any compound, which is suitable to support administration and delivery of the composition according to the invention. Furthermore, such an adjuvant may, without being bound thereto, initiate or increase an immune response of the innate immune system, i.e. a non-specific immune response. In other words, when administered, the composition according to the invention typically initiates an adaptive immune response due to an antigen as defined herein or a fragment or variant thereof, which is encoded by the at least one coding sequence of the inventive mRNA contained in the composition of the present invention. Additionally, the composition according to the invention may generate an (supportive) innate immune response due to addition of an adjuvant as defined herein to the composition according to the invention.

Such an adjuvant may be selected from any adjuvant known to a skilled person and suitable for the present case, i.e. supporting the induction of an immune response in a mammal. Preferably, the adjuvant may be selected from the group consisting of, without being limited thereto, TDM, MDP, muramyl dipeptide, pluronics, alum solution, aluminium hydroxide, ADJUMER™ (polyphosphazene); aluminium phosphate gel; glucans from algae; algammulin; aluminium hydroxide gel (alum); highly protein-adsorbing aluminium hydroxide gel; low viscosity aluminium hydroxide gel; AF or SPT (emulsion of squalane (5%), Tween 80 (0.2%), Pluronic L121 (1.25%), phosphate-buffered saline, pH 7.4); AVRIDINE™ (propanediamine); BAY R1005™ ((N—(2-deoxy-2-L-leucylamino-b-D-glucopyranosyl)— N—octadecyl-dodecanoyl-amide hydroacetate); CALCITRIOL™ (1-alpha,25-dihydroxy-vitamin D3); calcium phosphate gel; CAP™ (calcium phosphate nanoparticles); cholera holotoxin, cholera-toxin-A1-protein-A-D-fragment fusion protein, sub-unit B of the cholera toxin; CRL 1005 (block copolymer P1205); cytokine-containing liposomes; DDA (dimethyldioctadecylammonium bromide); DHEA (dehydroepiandrosterone); DMPC (dimyristoylphosphatidylcholine); DMPG (dimyristoylphosphatidylglycerol); DOC/alum complex (deoxycholic acid sodium salt); Freund's complete adjuvant; Freund's incomplete adjuvant; gamma inulin; Gerbu adjuvant (mixture of: i)N—acetylglucosaminyl-(P1-4)—N—acetylmuramyl-L-alanyl-D-glutamine (GMDP), ii) dimethyldioctadecylammonium chloride (DDA), iii) zinc-L-proline salt complex (ZnPro-8); GM-CSF); GMDP (N—acetylglucosaminyl-(b1-4)—N—acetylmuramyl-L-alanyl-D-isoglutamine); imiquimod (1-(2-methypropyl)-1H-imidazo[4,5-c]quinoline-4-amine);
ImmTher™ (N—acetylglucosaminyl—N—acetylmuramyl-L-Ala-D-isoGlu-L-Ala-glycerol dipalmitate); DRVs (immunoliposomes prepared from dehydration-rehydration vesicles); interferon-gamma; interleukin-1beta; interleukin-2; interleukin-7; interleukin-12; ISCOMS™; ISCOPREP 7.0.3.™; liposomes; LOXORIBINE™ (7-allyl-8-oxoguanosine); LT oral adjuvant (E. coli labile enterotoxin-protoxin); microspheres and microparticles of any composition; MF59™; (squalene-water emulsion); MONTANIDE ISA 51™ (purified incomplete Freund's adjuvant); MONTANIDE ISA 720™ (metabolisable oil adjuvant); MPL™ (3-Q-desacyl-4'-monophosphoryl lipid A); MTP—PE and MTP—PE liposomes ((N—acetyl-L-alanyl-D-isoglutaminyl-L-alanine-2-(1,2-dipalmitoyl-sn-glycero-3-(hydroxy-phosphoryloxy))-ethylamide, monosodium salt); MURAMETIDE™ (Nac-Mur-L-Ala-D-Gln-OCH3); MURAPALMITINE™ and D-MURAPALMITINE™ (Nac-Mur-L-Thr-D-isoGln-sn-glyceroldipalmitoyl); NAGO (neuraminidase-galactose oxidase); nanospheres or nanoparticles of any composition; NISVs (non-ionic surfactant vesicles); PLEURAN™ (β-glucan); PLGA, PGA and PLA (homo- and co-polymers of lactic acid and glycolic acid; microspheres/nanospheres); PLURONIC L121™; PMMA (polymethyl methacrylate); PODDS™ (proteinoid microspheres); polyethylene carbamate derivatives; poly-rA:poly-rU (polyadenylic acid-polyuridylic acid complex); polysorbate 80 (Tween 80); protein cochleates (Avanti Polar Lipids, Inc., Alabaster, Ala.); STIMULON™ (QS-21); Quil-A (Quil-A saponin); S-28463 (4-amino-otec-dimethyl-2-ethoxymethyl-1H-imidazo[4,5 c]quinoline-1-ethanol); SAF-1™ ("Syntex adjuvant formulation"); Sendai proteoliposomes and Sendai-containing lipid matrices; Span-85 (sorbitan trioleate); Specol (emulsion of Marcol 52, Span 85 and Tween 85); squalene or Robane® (2,6,10,15,19,23-hexamethyltetracosan and 2,6,10,15,19,23-hexamethyl-2,6, 10,14,18,22-tetracosahexane); stearyltyrosine (octadecyltyrosine hydrochloride); Theramid® (N—acetylglucosaminyl—N—acetylmuramyl-L-Ala-D-isoGlu-L-Ala-dipalmitoxypropylamide); Theronyl-MDP (Termurtide™ or [thr 1]-MDP; N—acetylmuramyl-L-threonyl-D-isoglutamine); Ty particles (Ty-VLPs or virus-like particles); Walter-Reed liposomes (liposomes containing lipid A adsorbed on aluminium hydroxide), and lipopeptides, including Pam3Cys, in particular aluminium salts, such as Adju-phos, Alhydrogel, Rehydragel; emulsions, including CFA, SAF, IFA, MF59, Provax, TiterMax, Montanide, Vaxfectin; copolymers, including Optivax (CRL1005), L121, Poloaxmer4010), etc.; liposomes, including Stealth, cochleates, including BIORAL; plant derived adjuvants, including QS21, Quil A, Iscomatrix, ISCOM; adjuvants suitable for costimulation including Tomatine, biopolymers, including PLG, PMM, Inulin; microbe derived adjuvants, including Romurtide, DETOX, MPL, CWS, Mannose, CpG nucleic acid sequences, CpG7909, ligands of human TLR 1-10, ligands of murine TLR 1-13, ISS-1018, IC31, Imidazoquinolines, Ampligen, Ribi529, IMOxine, IRIVs, VLPs, cholera toxin, heat-labile toxin, Pam3Cys, Flagellin, GPI anchor, LNFPIII/Lewis X, antimicrobial peptides, UC-1V150, RSV fusion protein, cdiGMP; and adjuvants suitable as antagonists including CGRP neuropeptide.

Particularly preferred, an adjuvant may be selected from adjuvants, which support induction of a Th1-immune response or maturation of naïve T-cells, such as GM-CSF, IL-12, IFNγ, any immunostimulatory nucleic acid as defined above, preferably an immunostimulatory RNA, CpG DNA, etc.

In a further preferred embodiment it is also possible that the inventive composition contains besides the antigen-providing mRNA further components which are selected from the group comprising: further antigens (e.g. in the form of a peptide or protein) or further antigen-encoding nucleic acids; a further immunotherapeutic agent; one or more auxiliary substances; or any further compound, which is known to be immunostimulating due to its binding affinity (as ligands) to human Toll-like receptors; and/or an adjuvant nucleic acid, preferably an immunostimulatory RNA (is-RNA).

The composition of the present invention can additionally contain one or more auxiliary substances in order to increase its immunogenicity or immunostimulatory capacity, if desired. A synergistic action of the mRNA as defined herein and of an auxiliary substance, which may be optionally contained in the inventive composition, is preferably achieved thereby. Depending on the various types of auxiliary substances, various mechanisms can come into consideration in this respect. For example, compounds that permit the maturation of dendritic cells (DCs), for example lipopolysaccharides, TNF-alpha or CD40 ligand, form a first class of suitable auxiliary substances. In general, it is possible to use as auxiliary substance any agent that influences the immune system in the manner of a "danger signal" (LPS, GP96, etc.) or cytokines, such as GM-CSF, which allow an immune response to be enhanced and/or influenced in a targeted manner. Particularly preferred auxiliary substances are cytokines, such as monokines, lymphokines, interleukins or chemokines, that further promote the innate immune response, such as IL-1, IL-2, IL-3, IL-4, IL-5, IL-6, IL-7, IL-8, IL-9, IL-10, IL-12, IL-13, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, IFN-alpha, IFN-beta, IFN—gamma, GM-CSF, G-CSF, M-CSF, LT-beta or TNF-alpha, growth factors, such as hGH.

Suitable adjuvants may also be selected from cationic or polycationic compounds wherein the adjuvant is preferably prepared upon complexing the mRNA of the composition according to the invention with the cationic or polycationic compound. Associating or complexing the mRNA of the composition with cationic or polycationic compounds as defined herein preferably provides adjuvant properties and confers a stabilizing effect to the mRNA of the composition. In particular, such preferred cationic or polycationic compounds are selected from cationic or polycationic peptides or proteins, including protamine, nucleoline, spermin or spermidine, or other cationic peptides or proteins, such as poly-L-lysine (PLL), poly-arginine, basic polypeptides, cell penetrating peptides (CPPs), including HIV-binding peptides, Tat, HIV-1 Tat (HIV), Tat-derived peptides, Penetratin, VP22 derived or analog peptides, HSV VP22 (Herpes simplex), MAP, KALA or protein transduction domains (PTDs, PpT620, proline-rich peptides, arginine-rich peptides, lysine-rich peptides, MPG-peptide(s), Pep-1, L-oligomers, Calcitonin peptide(s), Antennapedia-derived peptides (particularly from *Drosophila antennapedia*), pAntp, pIsl, FGF, Lactoferrin, Transportan, Buforin-2, Bac715-24, SynB, SynB(1), pVEC, hCT-derived peptides, SAP, protamine, spermine, spermidine, or histones. Further preferred cationic or polycationic compounds may include cationic polysaccharides, for example chitosan, polybrene, cationic polymers, e.g. polyethyleneimine (PEI), cationic lipids, e.g. DOTMA: [1-(2,3-sioleyloxy)propyl)]—N,N,N—trimethylammonium chloride, DMRIE, di-C14-amidine, DOTIM, SAINT, DC-Chol, BGTC, CTAP, DOPC, DODAP, DOPE: Dioleyl phosphatidylethanol-amine, DOSPA, DODAB, DOIC, DMEPC, DOGS: Dioctadecylamidoglicylspermin, DIMRI: Dimyristo-oxypropyl dimethyl hydroxyethyl ammonium bromide, DOTAP: dioleoyloxy-3-(trimethylammonio)propane, DC-6-14: O,O-ditetradecanoyl—N—(α-trimethylammonioacetyl)diethanolamine chloride, CLIP1: rac-[(2,3-dioctadecyloxypropyl)(2-hydroxyethyl)]-dimethylammonium chloride, CLIP6: rac-[2(2,3-dihexadecyloxypropyl-oxymethyloxy)ethyl]-trimethylammonium, CLIP9: rac-[2(2,3-dihexadecyloxypropyl-oxysuccinyloxy)ethyl]-trimethylammonium, oligofectamine, or cationic or polycationic polymers, e.g. modified polyaminoacids, such as β-aminoacid-polymers or reversed polyamides, etc., modified polyethylenes, such as PVP (poly(N—ethyl-4-vinylpyridinium bromide)), etc., modified acrylates, such as pDMAEMA (poly(dimethylaminoethyl methylacrylate)), etc., modified Amidoamines such as pAMAM (poly(amidoamine)), etc., modified polybetaaminoester (PBAE), such as diamine end modified 1,4 butanediol diacrylate-co-5-amino-1-pentanol polymers, etc., dendrimers, such as polypropylamine dendrimers or pAMAM based dendrimers, etc., polyimine(s), such as PEI: poly(ethyleneimine), poly(propyleneimine), etc., polyallylamine, sugar backbone based polymers, such as cyclodextrin based polymers, dextran based polymers, Chitosan, etc., silan backbone based polymers, such as PMOXA-PDMS copolymers, etc., blockpolymers consisting of a combination of one or more cationic blocks (e.g. selected of a cationic polymer as mentioned above) and of one or more hydrophilic- or hydrophobic blocks (e.g polyethyleneglycole); etc.

Additionally, preferred cationic or polycationic proteins or peptides, which can be used as an adjuvant by complexing the mRNA of the composition according to the invention, may be selected from following proteins or peptides having the following total formula (III): $(Arg)_l;(Lys)_m;(His)_n;(Orn)_o;(Xaa)_x$, wherein l+m+n+o+x=8-15, and l, m, n or o independently of each other may be any number selected from 0, 1, 2, 3, 4, 5, 6, 7, 8, 9, 10, 11, 12, 13, 14 or 15, provided that the overall content of Arg, Lys, His and Orn represents at least 50% of all amino acids of the oligopeptide; and Xaa may be any amino acid selected from native (=naturally occurring) or non-native amino acids except of Arg, Lys, His or Orn; and x may be any number selected from 0, 1, 2, 3 or 4, provided, that the overall content of Xaa does not exceed 50% of all amino acids of the oligopeptide. Particularly preferred oligoarginines in this context are e.g. Arg7, Arg8, Arg9, Arg7, H3R9, R9H3, H3R9H3, YSSR9SSY, (RKH)4, Y(RKH)2R, etc.

The ratio of the mRNA to the cationic or polycationic compound in the adjuvant component may be calculated on the basis of the nitrogen/phosphate ratio (N/P—ratio) of the entire mRNA complex, i.e. the ratio of positively charged (nitrogen) atoms of the cationic or polycationic compound to the negatively charged phosphate atoms of the nucleic acids. For example, 1 µg of RNA typically contains about 3 nmol phosphate residues, provided the RNA exhibits a statistical distribution of bases. Additionally, 1 µg of peptide typically contains about x nmol nitrogen residues, dependent on the molecular weight and the number of basic amino acids. When exemplarily calculated for (Arg)9 (molecular weight 1424 g/mol, 9 nitrogen atoms), 1 µg (Arg)9 contains about 700 pmol (Arg)9 and thus 700×9=6300 pmol basic amino acids=6.3 nmol nitrogen atoms. For a mass ratio of about 1:1 RNA/(Arg)9 an N/P ratio of about 2 can be calculated. When exemplarily calculated for protamine (molecular weight about 4250 g/mol, 21 nitrogen atoms, when protamine from salmon is used) with a mass ratio of about 2:1 with 2 µg RNA, 6 nmol phosphate are to be calculated for the RNA; 1 µg protamine contains about 235 pmol protamine molecules and thus 235×21=4935 pmol basic nitrogen atoms=4.9 nmol nitrogen atoms. For a mass ratio of about 2:1 RNA/protamine an N/P ratio of about 0.81 can be calculated. For a mass ratio of about 8:1 RNA/protamine an N/P ratio of about 0.2 can be calculated. In the context of the present invention, an N/P—ratio is preferably in the range of about 0.1-40, preferably in a range of about 0.3-4 and most preferably in a range of about 0.5-2 or 0.7-2 regarding the ratio of RNA:peptide in the complex, and most preferably in the range of about 0.7-1.5.

In a preferred embodiment, the composition of the present invention is obtained in two separate steps in order to obtain both, an efficient immunostimulatory effect and efficient translation of the mRNA according to the invention. Therein, a so called "adjuvant component" is prepared by complexing—in a first step—an mRNA as defined herein of the adjuvant component with a cationic or polycationic compound in a specific ratio to form a stable complex. In this context, it is important, that no free cationic or polycationic compound or only a negligibly small amount remains in the adjuvant component after complexing the mRNA. Accordingly, the ratio of the mRNA and the cationic or polycationic compound in the adjuvant component is typically selected in a range that the mRNA is entirely complexed and no free cationic or polycationic compound or only a negligible small amount remains in the composition. Preferably the ratio of the adjuvant component, i.e. the ratio of the mRNA to the cationic or polycationic compound is selected from a range of about 6:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w).

According to a preferred embodiment, the mRNA of the invention comprising at least one mRNA sequence comprising at least one coding region as defined herein is added in a second step to the complexed mRNA of the adjuvant component in order to form the (immunostimulatory) composition of the invention. Therein, the mRNA of the composition according to the invention is added as free mRNA, which is not complexed by other compounds. Prior to addition, the free mRNA is not complexed and will preferably not undergo any detectable or significant complexation reaction upon the addition of the adjuvant component. This is due to the strong binding of the cationic or polycationic compound to the above described mRNA according to the invention comprised in the adjuvant component. In other words, when the mRNA comprising at least one coding region as defined herein is added to the "adjuvant component", preferably no free or substantially no free cationic or polycationic compound is present, which could form a complex with the free mRNA. Accordingly, an efficient translation of the mRNA of the composition is possible in vivo. Therein, the free mRNA, may occur as a mono-, di-, or multicistronic mRNA, i.e. an mRNA which carries the coding sequences of one or more proteins. Such coding sequences in di-, or even multicistronic mRNA may be separated by at least one IRES sequence, e.g. as defined herein.

In a particularly preferred embodiment, the free mRNA as defined herein, which is comprised in the composition of the present invention, may be identical or different to the RNA as defined herein, which is comprised in the adjuvant component of the composition, depending on the specific requirements of therapy. Even more preferably, the free RNA, which is comprised in the composition according to the invention, is identical to the RNA of the adjuvant component of the inventive composition.

In a particularly preferred embodiment, the composition according to the invention comprises the mRNA of the invention, which encodes at least one antigenic peptide or protein as defined herein and wherein said mRNA is present in the composition partially as free mRNA and partially as complexed mRNA. Preferably, the mRNA as defined herein is complexed as described above and the same mRNA is then added as free mRNA, wherein preferably the compound, which is used for complexing the mRNA is not present in free form in the composition at the moment of addition of the free mRNA component.

The ratio of the first component (i.e. the adjuvant component comprising or consisting of the mRNA as defined herein complexed with a cationic or polycationic compound) and the second component (i.e. the free mRNA as defined herein) may be selected in the inventive composition according to the specific requirements of a particular therapy. Typically, the ratio of the mRNA in the adjuvant component and the at least one free mRNA (mRNA in the adjuvant component: free mRNA) of the composition according to the invention is selected such that a significant stimulation of the innate immune system is elicited due to the adjuvant component. In parallel, the ratio is selected such that a significant amount of the free mRNA can be provided in vivo leading to an efficient translation and concentration of the expressed protein in vivo, e.g. the at least one antigenic peptide or protein as defined herein. Preferably the ratio of the mRNA in the adjuvant component:free mRNA in the inventive composition is selected from a range of about 5:1 (w/w) to about 1:10 (w/w), more preferably from a range of about 4:1 (w/w) to about 1:8 (w/w), even more preferably from a range of about 3:1 (w/w) to about 1:5 (w/w) or 1:3 (w/w), and most preferably the ratio of mRNA in the adjuvant component:free mRNA in the inventive composition is selected from a ratio of about 1:1 (w/w).

Additionally or alternatively, the ratio of the first component (i.e. the adjuvant component comprising or consisting of the mRNA complexed with a cationic or polycationic compound) and the second component (i.e. the free mRNA) may be calculated on the basis of the nitrogen/phosphate ratio (N/P—ratio) of the entire mRNA complex. In the context of the present invention, an N/P—ratio is preferably in the range of about 0.1-10, preferably in a range of about 0.3-4 and most preferably in a range of about 0.5-2 or 0.7-2 regarding the ratio of mRNA:peptide in the complex, and most preferably in the range of about 0.7-1.5.

Additionally or alternatively, the ratio of the first component (i.e. the adjuvant component comprising or consisting of the mRNA complexed with a cationic or polycationic compound) and the second component (i.e. the free mRNA) may also be selected in the composition according to the invention on the basis of the molar ratio of both mRNAs to each other, i.e. the mRNA of the adjuvant component, being complexed with a cationic or polycationic compound and the free mRNA of the second component. Typically, the molar ratio of the mRNA of the adjuvant component to the free mRNA of the second component may be selected such, that the molar ratio suffices the above (w/w) and/or N/P— definitions. More preferably, the molar ratio of the mRNA of the adjuvant component to the free mRNA of the second component may be selected e.g. from a molar ratio of about 0.001:1, 0.01:1, 0.1:1, 0.2:1, 0.3:1, 0.4:1, 0.5:1, 0.6:1, 0.7:1, 0.8:1, 0.9:1, 1:1, 1:0.9, 1:0.8, 1:0.7, 1:0.6, 1:0.5, 1:0.4, 1:0.3, 1:0.2, 1:0.1, 1:0.01, 1:0.001, etc. or from any range formed by any two of the above values, e.g. a range selected from about 0.001:1 to 1:0.001, including a range of about 0.01:1 to 1:0.001, 0.1:1 to 1:0.001, 0.2:1 to 1:0.001, 0.3:1 to 1:0.001, 0.4:1 to 1:0.001, 0.5:1 to 1:0.001, 0.6:1 to 1:0.001, 0.7:1 to 1:0.001, 0.8:1 to 1:0.001, 0.9:1 to 1:0.001, 1:1 to 1:0.001, 1:0.9 to 1:0.001, 1:0.8 to 1:0.001, 1:0.7 to 1:0.001, 1:0.6 to 1:0.001, 1:0.5 to 1:0.001, 1:0.4 to 1:0.001, 1:0.3 to 1:0.001, 1:0.2 to 1:0.001, 1:0.1 to 1:0.001, 1:0.01 to 1:0.001, or a range of about 0.01:1 to 1:0.01, 0.1:1 to 1:0.01, 0.2:1 to 1:0.01, 0.3:1 to 1:0.01, 0.4:1 to 1:0.01, 0.5:1 to 1:0.01, 0.6:1 to 1:0.01, 0.7:1 to 1:0.01, 0.8:1 to 1:0.01, 0.9:1 to 1:0.01, 1:1 to 1:0.01, 1:0.9 to 1:0.01, 1:0.8 to 1:0.01, 1:0.7 to 1:0.01, 1:0.6 to 1:0.01, 1:0.5 to 1:0.01, 1:0.4 to 1:0.01, 1:0.3 to 1:0.01, 1:0.2 to 1:0.01, 1:0.1 to 1:0.01, 1:0.01 to 1:0.01, or including a range of about 0.001:1 to 1:0.01, 0.001:1 to 1:0.1, 0.001:1 to 1:0.2, 0.001:1 to 1:0.3, 0.001:1 to 1:0.4, 0.001:1 to 1:0.5, 0.001:1 to 1:0.6, 0.001:1 to 1:0.7, 0.001:1 to 1:0.8, 0.001:1 to 1:0.9, 0.001:1 to 1:1, 0.001 to 0.9:1, 0.001 to 0.8:1, 0.001 to 0.7:1, 0.001 to 0.6:1, 0.001 to 0.5:1, 0.001 to 0.4:1, 0.001 to 0.3:1, 0.001 to 0.2:1, 0.001 to 0.1:1, or a range of about 0.01:1 to 1:0.01, 0.01:1 to 1:0.1, 0.01:1 to 1:0.2, 0.01:1 to 1:0.3, 0.01:1 to 1:0.4, 0.01:1 to 1:0.5, 0.01:1 to 1:0.6, 0.01:1 to 1:0.7, 0.01:1 to 1:0.8, 0.01:1 to 1:0.9, 0.01:1 to 1:1, 0.001 to 0.9:1, 0.001 to 0.8:1, 0.001 to 0.7:1, 0.001 to 0.6:1, 0.001 to 0.5:1, 0.001 to 0.4:1, 0.001 to 0.3:1, 0.001 to 0.2:1, 0.001 to 0.1:1, etc.

Even more preferably, the molar ratio of the mRNA of the adjuvant component to the free mRNA of the second component may be selected e.g. from a range of about 0.01:1 to 1:0.01. Most preferably, the molar ratio of the mRNA of the adjuvant component to the free mRNA of the second component may be selected e.g. from a molar ratio of about 1:1. Any of the above definitions with regard to (w/w) and/or N/P ratio may also apply.

Suitable adjuvants may furthermore be selected from nucleic acids having the formula (Va): $G_l X_m G_n$, wherein: G is guanosine (guanine), uridine (uracil) or an analogue of guanosine (guanine) or uridine (uracil); X is guanosine (guanine), uridine (uracil), adenosine (adenine), thymidine (thymine), cytidine (cytosine) or an analogue of the above-mentioned nucleotides (nucleosides); l is an integer from 1 to 40, wherein when l=1 G is guanosine (guanine) or an analogue thereof, when l>1 at least 50% of the nucleotides are guanosine (guanine) or an analogue thereof; m is an integer and is at least 3; wherein when m=3 X is uridine (uracil) or an analogue thereof, when m>3 at least 3 successive uridines (uracils) or analogues of uridine (uracil) occur; n is an integer from 1 to 40, wherein when n=1 G is guanosine (guanine) or an analogue thereof, when n>1 at least 50% of the nucleotides (nucleosides) are guanosine (guanine) or an analogue thereof, or formula (Vb): $(N_u G_l X_m G_n N_v)_a$, wherein: G is guanosine (guanine), uridine (uracil) or an analogue of guanosine (guanine) or uridine (uracil), preferably guanosine (guanine) or an analogue thereof; X is guanosine (guanine), uridine (uracil), adenosine (adenine), thymidine (thymine), cytidine (cytosine), or an analogue of these nucleotides (nucleosides), preferably uridine (uracil) or an analogue thereof; N is a nucleic acid sequence having a length of about 4 to 50, preferably of about 4 to 40, more preferably of about 4 to 30 or 4 to 20 nucleic acids, each N independently being selected from guanosine (guanine), uridine (uracil), adenosine (adenine), thymidine (thymine), cytidine (cytosine) or an analogue of these nucleotides (nucleosides); a is an integer from 1 to 20, preferably from 1 to 15, most preferably from 1 to 10; l is an integer from 1 to 40, wherein when l=1, G is guanosine (guanine) or an analogue thereof, when l>1, at least 50% of these nucleotides (nucleosides) are guanosine (guanine) or an analogue thereof; m is an integer and is at least 3; wherein when m=3, X is uridine (uracil) or an analogue thereof, and when m>3, at least 3 successive uridines (uracils) or analogues of uridine (uracil) occur; n is an integer from 1 to 40, wherein when n=1, G is guanosine (guanine) or an analogue thereof, when n>1, at least 50% of these nucleotides (nucleosides) are guanosine (guanine) or an analogue thereof; u,v may be independently from each other an integer from 0 to 50, preferably wherein when u=0, v 1, or when v=0, u 1; wherein the nucleic acid molecule of formula (Vb) has a length of at least 50 nucleotides, preferably of at least 100 nucleotides, more preferably of at least 150 nucleotides, even more preferably of at least 200 nucleotides and most preferably of at least 250 nucleotides.

Other suitable adjuvants may furthermore be selected from nucleic acids having the formula (VI): $C_l X_m C_n$, wherein: C is cytidine (cytosine), uridine (uracil) or an analogue of cytidine (cytosine) or uridine (uracil); X is guanosine (guanine), uridine (uracil), adenosine (adenine), thymidine (thymine), cytidine (cytosine) or an analogue of the above-mentioned nucleotides (nucleosides); l is an integer from 1 to 40, wherein when l=1 C is cytidine (cytosine) or an analogue thereof, when l>1 at least 50% of the nucleotides are cytidine (cytosine) or an analogue thereof; m is an integer and is at least 3; wherein when m=3 X is uridine (uracil) or an analogue thereof, when m>3 at least 3 successive uridines (uracils) or analogues of uridine (uracil) occur; n is an integer from 1 to 40, wherein when n=1 C is cytidine (cytosine) or an analogue thereof, when n>1 at least 50% of the nucleotides (nucleosides) are cytidine (cytosine) or an analogue thereof.

In this context the disclosure of WO002008014979 and WO2009095226 is also incorporated herein by reference.

In a further aspect, the present invention provides a vaccine, which is based on the mRNA sequence according to the invention comprising at least one coding region as defined herein. The vaccine according to the invention is preferably a (pharmaceutical) composition as defined herein.

Accordingly, the vaccine according to the invention is based on the same components as the (pharmaceutical) composition described herein. Insofar, it may be referred to the description of the (pharmaceutical) composition as provided herein. Preferably, the vaccine according to the invention comprises at least one mRNA comprising at least one mRNA sequence as defined herein and a pharmaceutically acceptable carrier. In embodiments, where the vaccine comprises more than one mRNA sequence (such as a plurality of RNA sequences according to the invention, wherein each preferably encodes a distinct antigenic peptide or protein), the vaccine may be provided in physically separate form and may be administered by separate administration steps. The vaccine according to the invention may correspond to the (pharmaceutical) composition as described herein, especially where the mRNA sequences are provided by one single composition. However, the inventive vaccine may also be provided physically separated. For instance, in embodiments, wherein the vaccine comprises more than one mRNA sequences/species, these RNA species may be provided such that, for example, two, three, four, five or six separate compositions, which may contain at least one mRNA species/sequence each (e.g. three distinct mRNA species/sequences), each encoding distinct antigenic peptides or proteins, are provided, which may or may not be combined. Also, the inventive vaccine may be a combination of at least two distinct compositions, each composition comprising at least one mRNA encoding at least one of the antigenic peptides or proteins defined herein. Alternatively, the vaccine may be provided as a combination of at least one mRNA, preferably at least two, three, four, five, six or more mRNAs, each encoding one of the antigenic peptides or proteins defined herein. The vaccine may be combined to provide one single composition prior to its use or it may be used such that more than one administration is required to administer the distinct mRNA sequences/species encoding any of the antigenic peptides or proteins as defined herein. If the vaccine contains at least one mRNA sequence, typically at least two mRNA sequences, encoding the antigen combinations defined herein, it may e.g. be administered by one single administration (combining all mRNA species/sequences), by at least two separate administrations. Accordingly; any combination of mono-, bi- or multicistronic mRNAs encoding the at least one antigenic peptide or protein or any combination of antigens as defined herein (and optionally further antigens), provided as separate entities (containing one mRNA species) or as combined entity (containing more than one mRNA species), is understood as a vaccine according to the present invention. According to a particularly preferred embodiment of the inventive vaccine, the at least one antigen, preferably a combination as defined herein of at least two, three, four, five, six or more antigens encoded by the inventive composition as a whole, is provided as an individual (monocistronic) mRNA, which is administered separately.

As with the (pharmaceutical) composition according to the present invention, the entities of the vaccine may be provided in liquid and or in dry (e.g. lyophilized) form. They may contain further components, in particular further components allowing for its pharmaceutical use. The vaccine or the (pharmaceutical) composition may, e.g., additionally contain a pharmaceutically acceptable carrier and/or further auxiliary substances and additives and/or adjuvants.

The vaccine or (pharmaceutical) composition typically comprises a safe and effective amount of the mRNA according to the invention as defined herein, encoding an antigenic peptide or protein as defined herein or a fragment or variant thereof or a combination of antigens, preferably as defined herein. As used herein, "safe and effective amount" means an amount of the mRNA that is sufficient to significantly induce a positive modification of cancer or a disease or disorder related to cancer. At the same time, however, a "safe and effective amount" is small enough to avoid serious side-effects, that is to say to permit a sensible relationship between advantage and risk. The determination of these limits typically lies within the scope of sensible medical judgment. In relation to the vaccine or (pharmaceutical) composition of the present invention, the expression "safe and effective amount" preferably means an amount of the mRNA (and thus of the encoded antigen) that is suitable for stimulating the adaptive immune system in such a manner that no excessive or damaging immune reactions are achieved but, preferably, also no such immune reactions below a measurable level. Such a "safe and effective amount" of the mRNA of the (pharmaceutical) composition or vaccine as defined herein may furthermore be selected in dependence of the type of mRNA, e.g. monocistronic, bi- or even multicistronic mRNA, since a bi- or even multicistronic mRNA may lead to a significantly higher expression of the encoded antigen(s) than the use of an equal amount of a monocistronic mRNA. A "safe and effective amount" of the mRNA of the (pharmaceutical) composition or vaccine as defined above will furthermore vary in connection with the particular condition to be treated and also with the age and physical condition of the patient to be treated, the severity of the condition, the duration of the treatment, the nature of the accompanying therapy, of the particular pharmaceutically acceptable carrier used, and similar factors, within the knowledge and experience of the accompanying doctor. The vaccine or composition according to the invention can be used according to the invention for human and also for veterinary medical purposes, as a pharmaceutical composition or as a vaccine.

In a preferred embodiment, the mRNA of the (pharmaceutical) composition, vaccine or kit of parts according to the invention is provided in lyophilized form. Preferably, the lyophilized mRNA is reconstituted in a suitable buffer, advantageously based on an aqueous carrier, prior to administration, e.g. Ringer-Lactate solution, which is preferred, Ringer solution, a phosphate buffer solution. In a preferred embodiment, the (pharmaceutical) composition, the vaccine or the kit of parts according to the invention contains at least one, two, three, four, five, six or more mRNAs, preferably mRNAs which are provided separately in lyophilized form (optionally together with at least one further additive) and which are preferably reconstituted separately in a suitable buffer (such as Ringer-Lactate solution) prior to their use so as to allow individual administration of each of the (monocistronic) mRNAs.

The vaccine or (pharmaceutical) composition according to the invention may typically contain a pharmaceutically acceptable carrier. The expression "pharmaceutically acceptable carrier" as used herein preferably includes the liquid or non-liquid basis of the inventive vaccine. If the inventive vaccine is provided in liquid form, the carrier will be water, typically pyrogen-free water; isotonic saline or buffered (aqueous) solutions, e.g phosphate, citrate etc. buffered solutions. Particularly for injection of the inventive vaccine, water or preferably a buffer, more preferably an aqueous buffer, may be used, containing a sodium salt, preferably at least 50 mM of a sodium salt, a calcium salt, preferably at least 0.01 mM of a calcium salt, and optionally a potassium salt, preferably at least 3 mM of a potassium salt. According to a preferred embodiment, the sodium, calcium and, optionally, potassium salts may occur in the form of their halogenides, e.g. chlorides, iodides, or bromides, in the form of their hydroxides, carbonates, hydrogen carbonates, or sulfates, etc. Without being limited thereto, examples of sodium salts include e.g. NaCl, NaI, NaBr, $Na_2CO_3$, $NaHCO_3$, $Na_2SO_4$, examples of the optional potassium salts include e.g. KCl, KI, KBr, $K_2CO_3$, $KHCO_3$, $K_2SO_4$, and examples of calcium salts include e.g. $CaCl_2$, $CaI_2$, $CaBr_2$, $CaCO_3$, $CaSO_4$, $Ca(OH)_2$. Furthermore, organic anions of the aforementioned cations may be contained in the buffer. According to a more preferred embodiment, the buffer suitable for injection purposes as defined above, may contain salts selected from sodium chloride (NaCl), calcium chloride ($CaCl_2$) and optionally potassium chloride (KCl), wherein further anions may be present additional to the chlorides. $CaCl_2$ can also be replaced by another salt like KCl. Typically, the salts in the injection buffer are present in a concentration of at least 50 mM sodium chloride (NaCl), at least 3 mM potassium chloride (KCl) and at least 0.01 mM calcium chloride ($CaCl_2$)—The injection buffer may be hypertonic, isotonic or hypotonic with reference to the specific reference medium, i.e. the buffer may have a higher, identical or lower salt content with reference to the specific reference medium, wherein preferably such concentrations of the afore mentioned salts may be used, which do not lead to damage of cells due to osmosis or other concentration effects. Reference media are e.g. in "in vivo" methods occurring liquids such as blood, lymph, cytosolic liquids, or other body liquids, or e.g. liquids, which may be used as reference media in "in vitro" methods, such as common buffers or liquids. Such common buffers or liquids are known to a skilled person. Ringer-Lactate solution is particularly preferred as a liquid basis.

However, one or more compatible solid or liquid fillers or diluents or encapsulating compounds may be used as well, which are suitable for administration to a person. The term "compatible" as used herein means that the constituents of the inventive vaccine are capable of being mixed with the mRNA according to the invention as defined herein, in such a manner that no interaction occurs, which would substantially reduce the pharmaceutical effectiveness of the inventive vaccine under typical use conditions. Pharmaceutically acceptable carriers, fillers and diluents must, of course, have sufficiently high purity and sufficiently low toxicity to make them suitable for administration to a person to be treated. Some examples of compounds which can be used as pharmaceutically acceptable carriers, fillers or constituents thereof are sugars, such as, for example, lactose, glucose, trehalose and sucrose; starches, such as, for example, corn starch or potato starch; dextrose; cellulose and its derivatives, such as, for example, sodium carboxymethylcellulose, ethylcellulose, cellulose acetate; powdered tragacanth; malt; gelatin; tallow; solid glidants, such as, for example, stearic acid, magnesium stearate; calcium sulfate; vegetable oils, such as, for example, groundnut oil, cottonseed oil, sesame oil, olive oil, corn oil and oil from theobroma; polyols, such as, for example, polypropylene glycol, glycerol, sorbitol, mannitol and polyethylene glycol; alginic acid.

The choice of a pharmaceutically acceptable carrier is determined, in principle, by the manner, in which the pharmaceutical composition or vaccine according to the invention is administered. The composition or vaccine can be administered, for example, systemically or locally. Routes for systemic administration in general include, for example, transdermal, oral, parenteral routes, including subcutaneous, intravenous, intramuscular, intraarterial, intradermal and intraperitoneal injections and/or intranasal administration routes. Routes for local administration in general include, for example, topical administration routes but also intradermal, transdermal, subcutaneous, or intramuscular injections or intralesional, intracranial, intrapulmonal, intracardial, and sublingual injections. More preferably, composition or vaccines according to the present invention may be administered by an intradermal, subcutaneous, or intramuscular route, preferably by injection, which may be needle-free and/or needle injection. Compositions/vaccines are therefore preferably formulated in liquid or solid form. The suitable amount of the vaccine or composition according to the invention to be administered can be determined by routine experiments, e.g. by using animal models. Such models include, without implying any limitation, rabbit, sheep, mouse, rat, dog and non-human primate models. Preferred unit dose forms for injection include sterile solutions of water, physiological saline or mixtures thereof. The pH of such solutions should be adjusted to about 7.4. Suitable carriers for injection include hydrogels, devices for controlled or delayed release, polylactic acid and collagen matrices. Suitable pharmaceutically acceptable carriers for topical application include those which are suitable for use in lotions, creams, gels and the like. If the inventive composition or vaccine is to be administered perorally, tablets, capsules and the like are the preferred unit dose form. The pharmaceutically acceptable carriers for the preparation of unit dose forms which can be used for oral administration are well known in the prior art. The choice thereof will depend on secondary considerations such as taste, costs and storability, which are not critical for the purposes of the present invention, and can be made without difficulty by a person skilled in the art.

The inventive vaccine or composition can additionally contain one or more auxiliary substances in order to further increase the immunogenicity. A synergistic action of the mRNA contained in the inventive composition and of an auxiliary substance, which may be optionally be co-formulated (or separately formulated) with the inventive vaccine or composition as described above, is preferably achieved thereby. Depending on the various types of auxiliary substances, various mechanisms may play a role in this respect. For example, compounds that permit the maturation of dendritic cells (DCs), for example lipopolysaccharides, TNF-alpha or CD40 ligand, form a first class of suitable auxiliary substances. In general, it is possible to use as auxiliary substance any agent that influences the immune system in the manner of a "danger signal" (LPS, GP96, etc.) or cytokines, such as GM-CSF, which allow an immune response produced by the immune-stimulating adjuvant according to the invention to be enhanced and/or influenced in a targeted manner. Particularly preferred auxiliary substances are cytokines, such as monokines, lymphokines, interleukins or chemokines, that—additional to induction of the adaptive immune response by the encoded at least one antigen—promote the innate immune response, such as IL-1, IL-2, IL-3, IL-4, IL-5, IL-6, IL-7, IL-8, IL-9, IL-10, IL-12, IL-13, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, IFN-alpha, IFN-beta, IFN—gamma, GM-CSF, G-CSF, M-CSF, LT-beta or TNF-alpha, growth factors, such as hGH. Preferably, such immunogenicity increasing agents or compounds are provided separately (not co-formulated with the inventive vaccine or composition) and administered individually.

Further additives which may be included in the inventive vaccine or composition are emulsifiers, such as, for example, Tween; wetting agents, such as, for example, sodium lauryl sulfate; colouring agents; taste-imparting agents, pharmaceutical carriers; tablet-forming agents; stabilizers; antioxidants; preservatives.

The inventive vaccine or composition can also additionally contain any further compound, which is known to be immune-stimulating due to its binding affinity (as ligands) to human Toll-like receptors TLR1, TLR2, TLR3, TLR4, TLR5, TLR6, TLR7, TLR8, TLR9, TLR10, or due to its binding affinity (as ligands) to murine Toll-like receptors TLR1, TLR2, TLR3, TLR4, TLR5, TLR6, TLR7, TLR8, TLR9, TLR10, TLR11, TLR12 or TLR13.

Another class of compounds, which may be added to an inventive vaccine or composition in this context, may be CpG nucleic acids, in particular CpG-RNA or CpG-DNA. A CpG-RNA or CpG-DNA can be a single-stranded CpG-DNA (ss CpG-DNA), a double-stranded CpG-DNA (dsDNA), a single-stranded CpG-RNA (ss CpG-RNA) or a double-stranded CpG-RNA (ds CpG-RNA). The CpG nucleic acid is preferably in the form of CpG-RNA, more preferably in the form of single-stranded CpG-RNA (ss CpG-RNA). The CpG nucleic acid preferably contains at least one or more (mitogenic) cytosine/guanine dinucleotide sequence(s) (CpG motif(s)). According to a first preferred alternative, at least one CpG motif contained in these sequences, that is to say the C (cytosine) and the G (guanine) of the CpG motif, is unmethylated. All further cytosines or guanines optionally contained in these sequences can be either methylated or unmethylated. According to a further preferred alternative, however, the C (cytosine) and the G (guanine) of the CpG motif can also be present in methylated form.

According to one aspect of the present invention, the mRNA, the (pharmaceutical) composition or the vaccine may be used according to the invention (for the preparation of a medicament) for the treatment or prophylaxis of MERS coronavirus infections or disorders related thereto.

In this context, also included in the present invention are methods of treating or preventing MERS coronavirus infections or disorders related thereto, preferably as defined herein, by administering to a subject in need thereof a pharmaceutically effective amount of the mRNA, the (pharmaceutical) composition or the vaccine according to the invention. Such a method typically comprises an optional first step of preparing the mRNA, the composition or the vaccine of the present invention, and a second step, comprising administering (a pharmaceutically effective amount of) said composition or vaccine to a patient/subject in need thereof. A subject in need thereof will typically be a mammal. In the context of the present invention, the mammal is preferably selected from the group comprising, without being limited thereto, e.g. goat, cattle, swine, dog, cat, donkey, monkey, ape, a rodent such as a mouse, hamster, rabbit and, particularly, human.

The invention also relates to the use of the mRNA sequence, the composition or the vaccine according to the invention, preferably for eliciting an immune response in a mammal, preferably for the treatment or prophylaxis of MERS coronavirus infections or a related condition as defined herein.

The present invention furthermore comprises the use of the mRNA sequence, the (pharmaceutical) composition or the vaccine according to the invention as defined herein for modulating, preferably for inducing or enhancing, an immune response in a mammal as defined herein, more preferably for preventing and/or treating MERS coronavirus infections, or of diseases or disorders related thereto.

In this context, the treatment or prophylaxis of MERS coronavirus infections according to the invention may comprise a combination of the inventive (pharmaceutical) composition or vaccine with a conventional MERS coronavirus therapy method. In some embodiments, the treatment or prophylaxis comprises administration of an antiviral drug.

In particular, the treatment or prophylaxis may comprise further comprise administration of a compound targeting a cellular receptor involved in infection with a MERS coronavirus, such as dipeptidyl peptidase-4 (DDP4, CD26) or a homolog thereof. In a preferred embodiment, the treatment or prophylaxis comprises administration of a compound, which is preferably an antagonist of DDP4, such as, for example, Sitagliptin (Januvia®, Xelevia®), Vildagliptin (Galvus®, Eucreas®) or Saxagliptin (Onglyza®). According to a preferred embodiment, the treatment or prophylaxis comprises administration of an antibody directed to DDP4 or a homolog thereof. In other embodiments, the treatment or prophylaxis comprises administration of a compound, which results in decreased expression of DDP4, for example an siRNA.

Accordingly, any use of the mRNA sequence, the (pharmaceutical) composition or the vaccine according to the invention in co-therapy with any other approach, preferably one or more of the above therapeutic approaches, in particular in combination with antivirals is within the scope of the present invention.

For administration, preferably any of the administration routes may be used as defined herein. In particular, an administration route is used, which is suitable for treating or preventing a MERS coronavirus infection as defined herein or diseases or disorders related thereto, by inducing or enhancing an adaptive immune response on the basis of an antigen encoded by the mRNA sequence according to the invention. Administration of the composition and/or the vaccine according to the invention may then occur prior, concurrent and/or subsequent to administering another composition and/or vaccine as defined herein, which may—in addition—contain another mRNA sequence or combination of mRNA sequences encoding a different antigen or combination of antigens, wherein each antigen encoded by the mRNA sequence according to the invention is preferably suitable for the treatment or prophylaxis of MERS coronavirus infections and diseases or disorders related thereto. In this context, a treatment as defined herein may also comprise the modulation of a disease associated to MERS coronavirus infection and of diseases or disorders related thereto.

According to a preferred embodiment of this aspect of the invention, the (pharmaceutical) composition or the vaccine according to the invention is administered by injection. Any suitable injection technique known in the art may be employed. Preferably, the inventive composition is administered by injection, preferably by needle-less injection, for example by jet-injection.

In one embodiment, the inventive composition comprises at least one, two, three, four, five, six, seven, eight, nine, ten, eleven, twelve or more mRNAs as defined herein, each of which is preferably injected separately, preferably by needle-less injection. Alternatively, the inventive composition comprises at least one, two, three, four, five, six, seven, eight, nine, ten, eleven, twelve or more mRNAs, wherein the at least one, two, three, four, five, six, seven, eight, nine, ten, eleven, twelve or more mRNAs are administered, preferably by injection as defined herein, as a mixture.

The immunization protocol for the immunization of a subject against an antigen or a combination of at least two, three, four, five, six, seven, eight, nine, ten, eleven, twelve or more antigens as defined herein typically comprises a series of single doses or dosages of the (pharmaceutical) composition or the vaccine according to the invention. A single dosage, as used herein, refers to the initial/first dose, a second dose or any further doses, respectively, which are preferably administered in order to "boost" the immune reaction. In this context, each single dosage preferably comprises the administration of the same antigen or the same combination of antigens as defined herein, wherein the interval between the administration of two single dosages can vary from at least one day, preferably 2, 3, 4, 5, 6 or 7 days, to at least one week, preferably 2, 3, 4, 5, 6, 7 or 8 weeks. The intervals between single dosages may be constant or vary over the course of the immunization protocol, e.g. the intervals may be shorter in the beginning and longer towards the end of the protocol. Depending on the total number of single dosages and the interval between single dosages, the immunization protocol may extend over a period of time, which preferably lasts at least one week, more preferably several weeks (e.g. 2, 3, 4, 5, 6, 7, 8, 9, 10, 11 or 12 weeks), even more preferably several months (e.g. 3, 4, 5, 6, 7, 8, 9, 10, 11, 12, 18 or 24 months). Each single dosage preferably encompasses the administration of an antigen, preferably of a combination of at least two, three, four, five, six, seven, eight, nine, ten, eleven, twelve or more antigens as defined herein and may therefore involve at least one, preferably 1, 2, 3, 4, 5, 6, 7, 8, 9, 10, 11 or 12 injections. In some cases, the composition or the vaccine according to the invention is administered as a single dosage typically in one injection. In the case, where the vaccine according to the invention comprises separate mRNA formulations encoding distinct antigens as defined herein, the minimum number of injections carried out during the administration of a single dosage corresponds to the number of separate components of the vaccine. In certain embodiments, the administration of a single dosage may encompass more than one injection for each component of the vaccine (e.g. a specific mRNA formulation comprising an mRNA encoding, for instance, one antigenic peptide or protein as defined herein). For example, parts of the total volume of an individual component of the vaccine may be injected into different body parts, thus involving more than one injection. In a more specific example, a single dosage of a vaccine comprising four separate mRNA formulations, each of which is administered in two different body parts, comprises eight injections. Typically, a single dosage comprises all injections required to administer all components of the vaccine, wherein a single component may be involve more than one injection as outlined above. In the case, where the administration of a single dosage of the vaccine according to the invention encompasses more than one injection, the injection are carried out essentially simultaneously or concurrently, i.e. typically in a time-staggered fashion within the time-frame that is required for the practitioner to carry out the single injection steps, one after the other. The administration of a single dosage therefore preferably extends over a time period of several minutes, e.g. 2, 3, 4, 5, 10, 15, 30 or 60 minutes.

Administration of the mRNA sequence as defined herein, the (pharmaceutical) composition or the vaccine according to the invention may be carried out in a time staggered treatment. A time staggered treatment may be e.g. administration of the mRNA sequence, the composition or the vaccine prior, concurrent and/or subsequent to a conventional therapy of a MERS coronavirus infections or diseases or disorders related thereto, e.g. by administration of the mRNA sequence, the composition or the vaccine prior, concurrent and/or subsequent to a therapy or an administration of a therapeutic suitable for the treatment or prophylaxis of MERS coronavirus infections or diseases or disorders related thereto. Such time staggered treatment may be carried out using e.g. a kit, preferably a kit of parts as defined herein.

Time staggered treatment may additionally or alternatively also comprise an administration of the mRNA sequence as defined herein, the (pharmaceutical) composition or the vaccine according to the invention in a form, wherein the mRNA encoding an antigenic peptide or protein as defined herein or a fragment or variant thereof, preferably forming part of the composition or the vaccine, is administered parallel, prior or subsequent to another mRNA sequence encoding an antigenic peptide or protein as defined above, preferably forming part of the same inventive composition or vaccine. Preferably, the administration (of all mRNA sequences) occurs within an hour, more preferably within 30 minutes, even more preferably within 15, 10, 5, 4, 3, or 2 minutes or even within 1 minute. Such time staggered treatment may be carried out using e.g. a kit, preferably a kit of parts as defined herein.

In a preferred embodiment, the pharmaceutical composition or the vaccine of the present invention is administered repeatedly, wherein each administration preferably comprises individual administration of the at least one mRNA of the inventive composition or vaccine. At each time point of administration, the at least one mRNA may be administered more than once (e.g. 2 or 3 times). In a particularly preferred embodiment of the invention, at least two, three, four, five, six or more mRNA sequences (each encoding a distinct one of the antigens as defined herein) are administered at each time point, wherein each mRNA is administered twice by injection, distributed over the four limbs.

Kit or Kit of Parts:

According to another aspect of the present invention, the present invention also provides a kit, in particular a kit of parts, comprising the mRNA sequence as defined herein, the (pharmaceutical) composition, and/or the vaccine according to the invention, optionally a liquid vehicle for solubilising and optionally technical instructions with information on the administration and dosage of the mRNA sequence, the composition and/or the vaccine. The technical instructions may contain information about administration and dosage of the mRNA sequence, the composition and/or the vaccine. Such kits, preferably kits of parts, may be applied e.g. for any of the above mentioned applications or uses, preferably for the use of the mRNA sequence according to the invention (for the preparation of an inventive medicament, preferably a vaccine) for the treatment or prophylaxis of MERS coronavirus infections or diseases or disorders related thereto. The kits may also be applied for the use of the mRNA sequence, the composition or the vaccine as defined herein (for the preparation of an inventive vaccine) for the treatment or prophylaxis of MERS coronavirus infections or diseases or disorders related thereto, wherein the mRNA sequence, the composition and/or the vaccine may be capable of inducing or enhancing an immune response in a mammal as defined above. Such kits may further be applied for the use of the mRNA sequence, the composition or the vaccine as defined herein (for the preparation of an inventive vaccine) for modulating, preferably for eliciting, e.g. to induce or enhance, an immune response in a mammal as defined above, and preferably for supporting treatment or prophylaxis of MERS coronavirus infections or diseases or disorders related thereto. Kits of parts, as a special form of kits, may contain one or more identical or different compositions and/or one or more identical or different vaccines as described herein in different parts of the kit. Kits of parts may also contain an (e.g. one) composition, an (e.g. one) vaccine and/or the mRNA sequence according to the invention in different parts of the kit, e.g. each part of the kit containing an mRNA sequence as defined herein, preferably encoding a distinct antigen. Preferably, the kit or the kit of parts contains as a part a vehicle for solubilising the mRNA according to the invention, the vehicle preferably being Ringer-lactate solution. Any of the above kits may be used in a treatment or prophylaxis as defined above.

In another embodiment of this aspect, the kit according to the present invention may additionally contain at least one adjuvant. In a further embodiment, the kit according to the present invention may additionally contain at least one further pharmaceutically active component, preferably a therapeutic compound suitable for treatment and/or prophylaxis of cancer or a related disorder. Moreover, in another embodiment, the kit may additionally contain parts and/or devices necessary or suitable for the administration of the composition or the vaccine according to the invention, including needles, applicators, patches, injection-devices.

EXAMPLES

Figure 1:
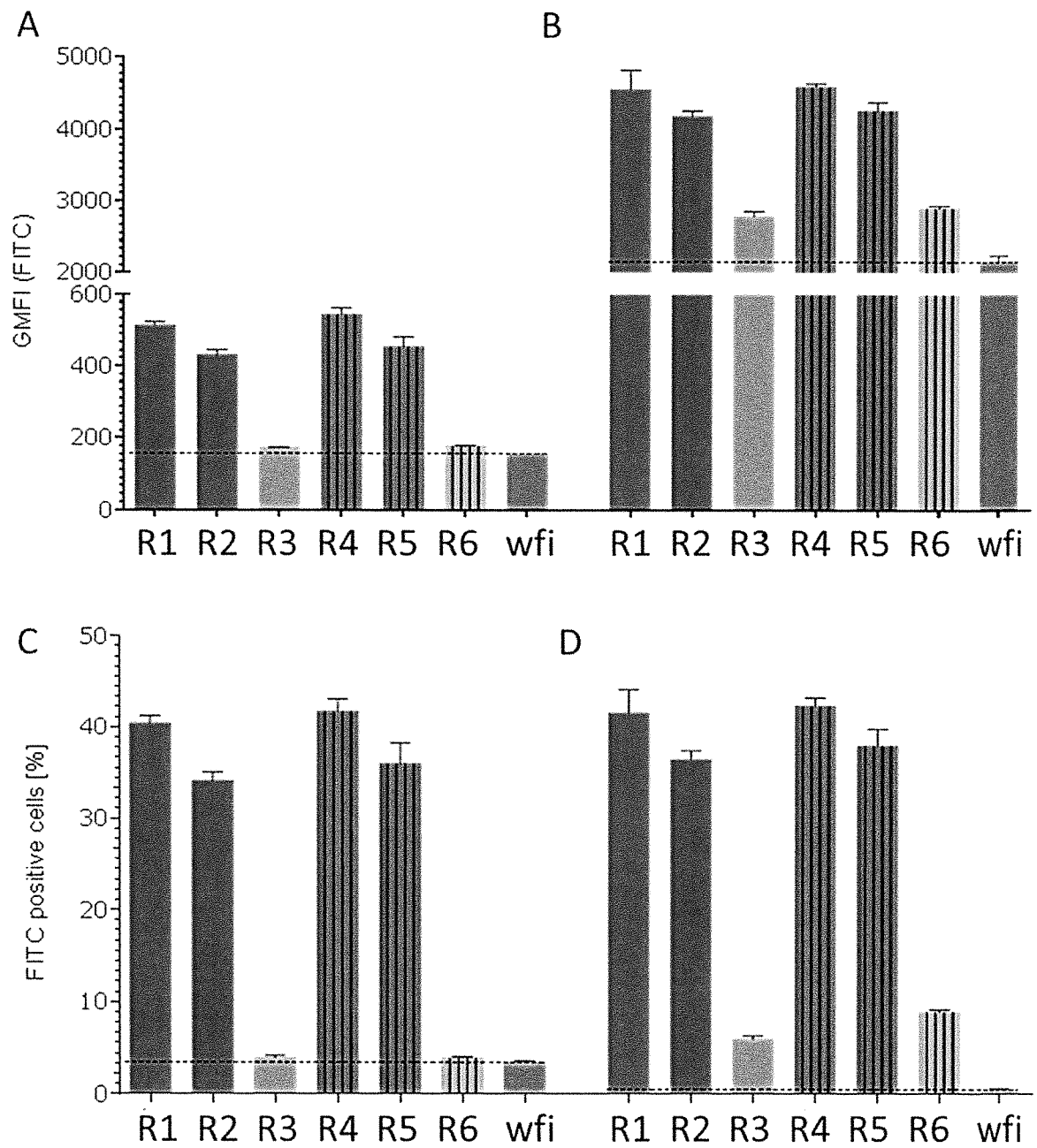
FIG. 1: shows that mRNA encoding MERS coronavirus/MERS-CoV antigenic proteins are expressed in cells after transfection of the mRNA. Shown are the results of a FACS analysis. Panels A and C show cell surface staining; Panels B and D show intracellular staining. Further details are provided in Example 2.

The Examples shown in the following are merely illustrative and shall describe the present invention in a further way. These Examples shall not be construed to limit the present invention thereto.

Example 1: Preparation of mRNA Constructs for In Vitro and In Vivo Experiments

For the present examples, DNA sequences encoding MERS coronavirus/MERS-CoV antigenic proteins were prepared and used for subsequent RNA in vitro transcription reactions. DNA sequences were prepared by modifying the wild type encoding DNA sequences by introducing a GC-optimized sequence for stabilization, using an in silico algorithms that increase the GC content of the respective coding sequence. Moreover, sequences were introduced into a pUC19 derived vector and modified to comprise stabilizing sequences derived from alpha-globin-3'-UTR, a stretch of 30 cytosines, a histone-stem-loop structure, and a stretch of 64 adenosines at the 3'-terminal end (poly-A-tail) (indicated as "mRNA design 1" in Table X1). Other sequences were introduced into a pUC19 derived vector to comprise stabilizing sequences derived from 32L4 5'-UTR ribosomal 5'TOP UTR and 3'-UTR derived from albumin 7, a stretch of 30 cytosines, a histone-stem-loop structure, and a stretch of 64 adenosines at the 3'-terminal end (poly-A-tail) (indicated as "mRNA design 2" in Table X1). The obtained plasmid DNA constructs were transformed and propagated in bacteria (*Escherichia coli*) using common protocols known in the art.

RNA In Vitro Transcription on Linearized pDNA:

The DNA plasmids prepared according to paragraph 1 were enzymatically linearized using EcoRI and transcribed in vitro using DNA dependent T7 RNA polymerase in the presence of a nucleotide mixture and cap analog (m7GpppG) under suitable buffer conditions. RNA production is performed under current good manufacturing practice according to WO2016180430. The obtained mRNAs were purified using PureMessenger® (CureVac, Tubingen, Germany; WO2008077592) and used for in vitro and in vivo experiments.

RNA constructs used in the present Examples are provided in Table X1. Therein, the respective antigen name is indicated, the corresponding protein SEQ ID NO and the mRNA SEQ ID NO. Three different Spike constructs were tested (S=full length; S(V1060P,K1061P)=mutant comprising two consecutive proline residues at the beginning of the central helix for retaining S protein in the prototypical prefusion conformation; S1) comprising either the endogenous signal peptide (R1-R3) or a heterologous signal peptide (HsIgE; R4-R6).

TABLE X1 mRNA constructs of the Example section (Example 1):

| Name | SEQ ID NO of encoded antigen | SEQ ID NO: mRNA design 2 | RNA ID |
|---|---|---|---|
| S | 16 | 2377 | R1 |
| S(V1060P, K1061P) | 2357 | 2373 | R2 |
| S1 | 1463 | 2378 | R3 |
| HsIgE(1-18)_S(18-1353) | 2358 | 2374 | R4 |
| HsIgE(1-18)_S(18-1353, V1060P, K1061P) | 2359 | 2375 | R5 |
| HsIgE(1-18)_S(18-747) | 2360 | 2376 | R6 |

Example 2: Expression of MERS Coronavirus/MERS-CoV Proteins in HeLa Cells and Analysis by FACS The results of the present Example show that mRNA encoding MERS coronavirus/MERS-CoV proteins are translated in cells after transfection of the mRNA.

To determine in vitro protein expression of the mRNA constructs, HeLa cells were transiently transfected with mRNA encoding MERS coronavirus/MERS-CoV antigens and stained using a suitable anti-S protein antibodies (raised in mouse), counterstained with a FITC-coupled secondary antibody (F5262 from Sigma). HeLa cells were seeded in a 6-well plate at a density of 400,000 cells/well in cell culture medium (RPMI, 10% FCS, 1% L-Glutamine, 1% Pen/Strep), 24 h prior to transfection. HeLa cells were transfected with 1 µg and 2 µg unformulated mRNA using Lipofectamine 2000 (Invitrogen). The mRNA constructs prepared according to Example 1 and listed in Table X1 were used in the experiment (SEQ ID NOs: 2373-2378; RNA ID: R1-R6), including a negative control (water for injection). 24 hours post transfection, HeLa cells are stained with suitable anti anti-NiV or anti-HeV antibodies (raised in mouse; 1:500) and anti-mouse FITC labelled secondary antibody (1:500) and subsequently analyzed by flow cytometry (FACS) on a BD FACS Canto II using the FACS Diva software. Quantitative analysis of the fluorescent FITC signal is performed using the FlowJo software package (Tree Star, Inc.). The results are shown in FIG. 1.

Results:

The results show that the used constructs led to a detectable protein expression at the cell surface for full length S construct (R1 and R4) and the stabilized S construct (R2 and R5). Moreover, a detectable intracellular protein expression for full length S construct (R1 and R4), the stabilized S construct (R2 and R5), and the S1 construct (R3 and R6) was shown. The results exemplify that the inventive mRNA encoding S proteins is translated in cells and that alternative RNA constructs as described in the present invention may also be translated in cells, which is a prerequisite for an mRNA-based vaccine.

Example 3: Expression Analysis of MERS Coronavirus/MERS-CoV Proteins Using Western Blot The results of the present Example shows that mRNA encoding Nipah virus G protein and Hendra virus G protein are expressed in HeLa cells after transfection.

For the analysis of MERS coronavirus/MERS-CoV, HeLa cells were transfected with unformulated mRNA (wfi as negative control) using Lipofectamine as the transfection agent. The mRNA constructs prepared according to Example 1 and listed in Table X1 were used in the experiment (SEQ ID NOs: 2373-2378; RNA ID: R1-R6), including a negative control (water for injection) and a positive control (S protein). Post transfection, HeLa cells were detached by trypsin-free/EDTA buffer, harvested, and cell lysates were prepared. Cell lysates were subjected to SDS-PAGE followed by western blot detection. Western Blot analysis was performed using an anti-S protein antibody used in combination with a suitable secondary antibody. The presence of αβ-tubulin was analyzed (4-tubulin; Cell Signalling Technology; 1:1000 diluted). MERS S protein was used as a positive control.

Figure 2:
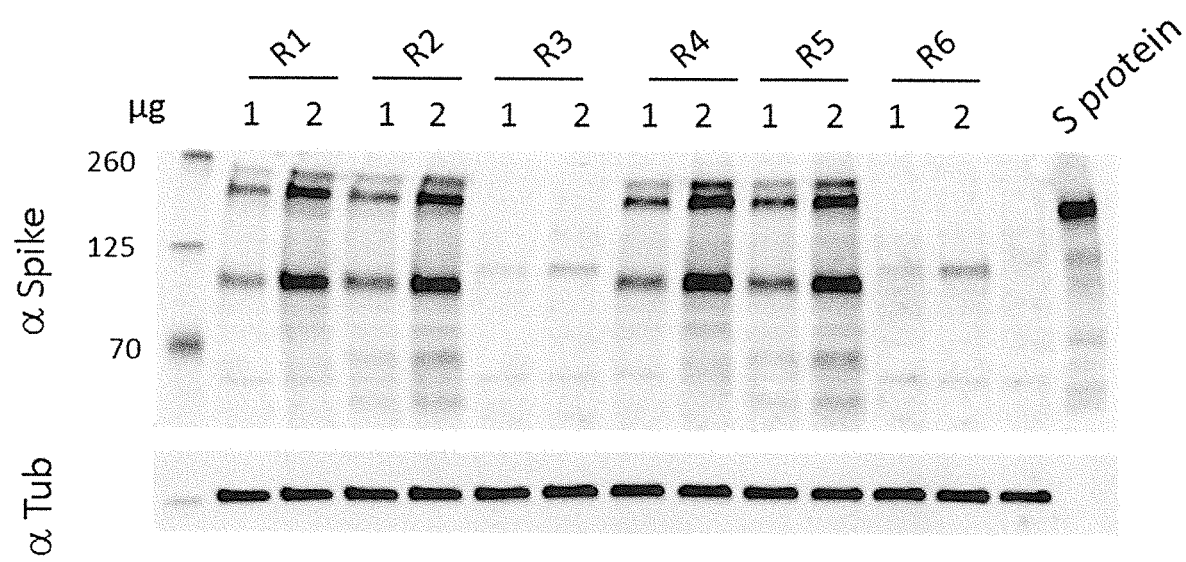
FIG. 2: shows that mRNA encoding MERS coronavirus/MERS-CoV antigenic proteins are expressed in cells after transfection of the mRNA. Shown are the results of a western blot analysis. Further details are provided in Example 3.

Results:

As shown in FIG. 2, the mRNA encoding MERS coronavirus/MERS-CoV S proteins is expressed in HeLa cell lysates.

The results exemplify that the inventive mRNA encoding MERS coronavirus/MERS-CoV S proteins is translated in cells and that alternative mRNA as described in the present invention may also be translated in cells, which is a prerequisite for an mRNA-based vaccine.

Example 4: Vaccination of Mice with mRNA Encoding MERS Coronavirus/MERS-CoV Antigens and ELISA Analysis The results of the present Example shows that mRNA encoding MERS coronavirus/MERS-CoV antigens are expressed in mice after intradermal injection. In addition, the expressed antigens provided by the inventive mRNA induces humoral immune responses after immunization in mice.

Preparation of Protamine Complexed mRNA

Nipah virus mRNA construct (SEQ ID NO: 1353) was prepared as described in Example 1 (RNA in vitro transcription). HPLC purified mRNA was complexed with protamine prior to use in in vivo vaccination experiments. The mRNA complexation consisted of a mixture of 50% free mRNA and 50% mRNA complexed with protamine at a weight ratio of 2:1. First, mRNA was complexed with protamine by addition of protamine-Ringer's lactate solution to mRNA. After incubation for 10 minutes, when the complexes were stably generated, free mRNA was added, and the final concentration of the vaccine was adjusted with Ringer's lactate solution.

Immunization:

Female BALB/c mice (6-8 weeks old) were injected intradermally (i.d.) with mRNA vaccine compositions with doses, application routes and vaccination schedules as indicated in Table X2. As a negative control, one group of mice was vaccinated with buffer (ringer lactate). All animals were vaccinated on day 0, 21 and 42. Blood samples were collected on day 21 (post prime) and 35 (post boost) for the determination of antibody titers (ELISA).

TABLE X2

| Vaccination regimen (Example 4): | | | |
|---|---|---|---|
| Group | Composition | Dose | Route | Volume |
| 1 | Full length S SEQ ID NO: 2377; RNA ID: R1 Protamine formulated | 80 µg | i.d.; back of the animal | 2 × 50 µl |
| 2 | HsIgE(1-18)_S(18-747) SEQ ID NO: 2360; RNA ID: R6 Protamine formulated | 80 µg | i.d.; back of the animal | 2 × 50 µl |
| 3 | 100% RiLa Control | — | i.d.; back of the animal | 2 × 50 µl |

Determination of IgG1 and IgG2 Antibody Titers Using ELISA:

Coated plates are incubated using respective serum dilutions, and binding of specific antibodies to the MERS coronavirus/MERS-CoV antigens are detected using biotinylated isotype specific anti-mouse antibodies followed by streptavidin-HRP (horse radish peroxidase) with ABTS as substrate. IgG1 and IgG2 titers directed against MERS coronavirus/MERS-CoV antigens were measured by ELISA on day 21 (post prime vaccination) and 35 (post boost vaccination).

Figure 3:
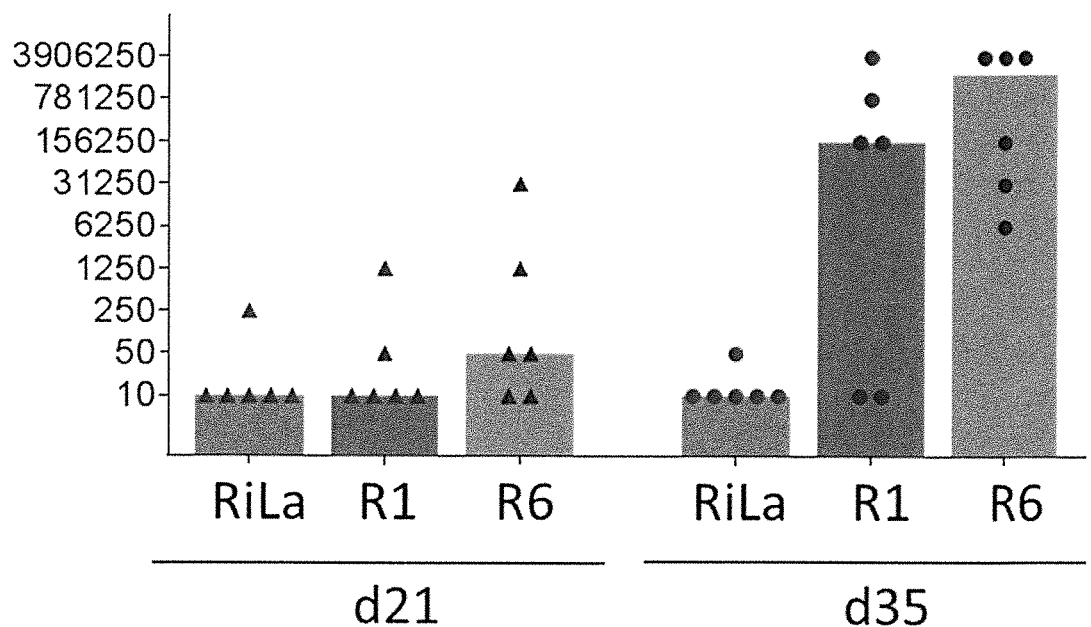
FIG. 3: shows that mRNA encoding MERS coronavirus/MERS-CoV antigenic proteins are expressed in vivo and that humoral immune responses are induced in mice. Shown are the results of an ELISA analysis. Panel A shows IgG1 endpoint titers; Panel B shows IgG2 endpoint titers. Further details are provided in Example 4.
Figure 3:
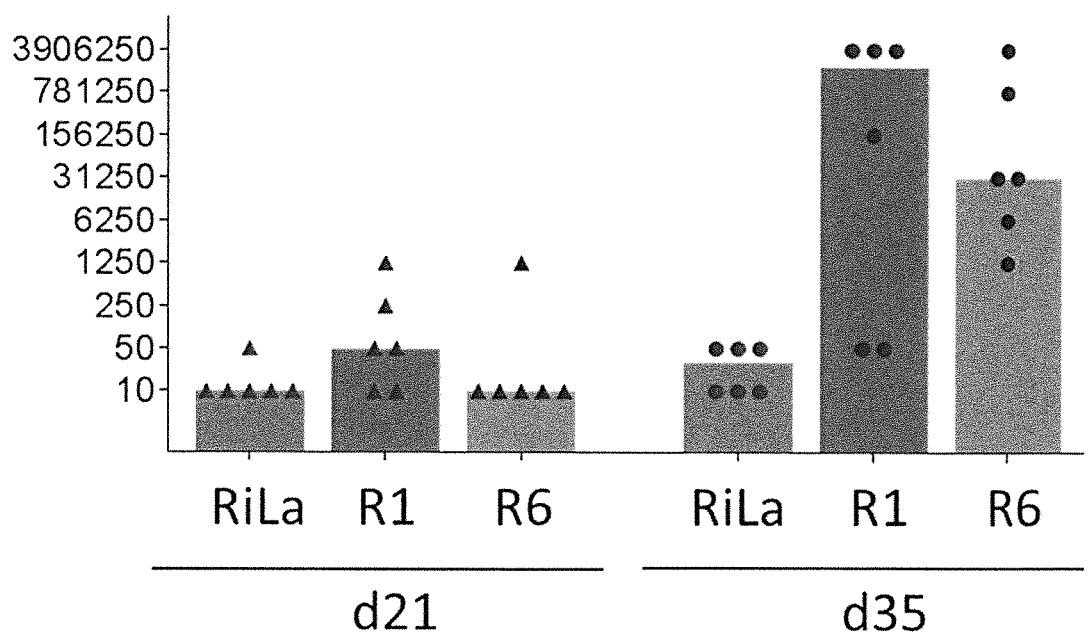

Results:

As shown in FIG. 3, the mRNA encoding MERS coronavirus/MERS-CoV antigens are expressed in mice after intradermal injection. In addition, the expressed antigens provided by the inventive mRNA induces humoral immune responses after immunization in mice. In detail, boost vaccination induces clear ELISA responses in 4/6 animals in R1 (full length S) and 6/6 animals in R6 ((HsIgE(1-18)_3 (18-747)). The results exemplify that the inventive mRNA encoding MERS coronavirus/MERS-CoV S proteins is translated in vivo and induces humoral immune responses in mice. Notably, alternative mRNA constructs as described in the present invention may also be translated in vivo and induce humoral immune responses in mice, which is a prerequisite for an effective mRNA-based MERS coronavirus/MERS-CoV vaccine.

Example 5: Analysis of Antigen-Specific Humoral Immune Responses in Mice Using a Cell-Based Assay The results of the present Example shows that mRNA encoding MERS coronavirus/MERS-CoV antigens induces antigen-specific humoral immune responses after immunization in mice.

Hela cells were transfected with 2 μg of RNA ID: R1 (SEQ ID NO: 2377) using lipofectamine. The cells were harvested 20 h post transfection, and seeded at $1 \times 10^5$ per well into an 96 well plate. The cells were incubated with sera of mice vaccinated with RNA ID: R1 (SEQ ID NO: 2377) (diluted 1:50; day 35) obtained from Example 4, followed by FITC-conjugated anti-mouse IgG antibody. Cells were acquired on BD FACS Canto II using DIVA software and analyzed by FlowJo.

Figure 4:
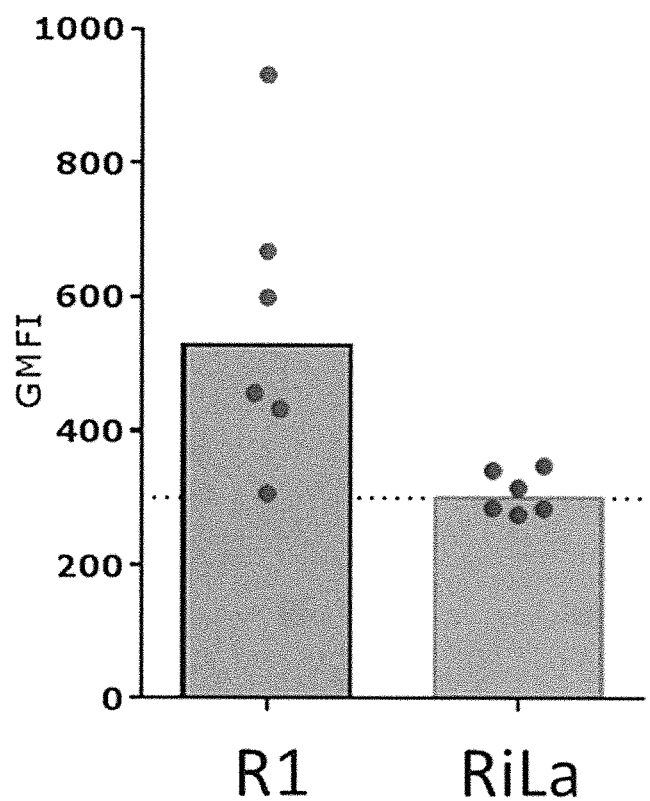
FIG. 4: shows that mRNA encoding MERS coronavirus/MERS-CoV antigenic proteins induces specific humoral immune responses after immunization in mice. Further details are provided in Example 5.

Results:

As shown in FIG. 4, the mRNA encoding MERS coronavirus/MERS-CoV S1 protein (mRNA construct R1) is expressed in mice after i.d. administration. Moreover, as antigen-specific IgGs were detected in sera of immunized mice, the results also show that the applied mRNA vaccine is suitable to induce antigen-specific humoral immune responses. The results exemplify that the inventive mRNA-based vaccine works and that similar mRNA vaccines comprising alternative mRNA constructs according to the invention may also be suitably used.

Example 6: Preparation of MERS Coronavirus/MERS-CoV Vaccine Compositions

The results of the previous Examples showed that the inventive MERS coronavirus/MERS-CoV mRNA constructs are expressed in vitro and in vivo, and that the mRNA vaccine (protamine formulated) induces specific humoral immune responses in mice after i.d. administration. For further in vivo vaccination experiments, other mRNA vaccine compositions are prepared, preferably using constructs listed in Table X1. One composition comprises mRNA that is encapsulated in lipid nanoparticles (LNPs), and one composition comprises polymer-lipidoid complexed mRNA.

Preparation of LNP Encapsulated mRNA

A lipid nanoparticle (LNP)-encapsulated mRNA mixture is prepared using an ionizable amino lipid (cationic lipid), phospholipid, cholesterol and a PEGylated lipid. LNPs are prepared as follows. Cationic lipid, DSPC, cholesterol and PEG-lipid are solubilized in ethanol. Briefly, mRNA mixture is diluted to a total concentration of 0.05 mg/mL in 50 mM citrate buffer, pH 4. Syringe pumps are used to mix the ethanolic lipid solution with the mRNA mixture at a ratio of about 1:6 to 1:2 (vol/vol). The ethanol is then removed and the external buffer replaced with PBS by dialysis. Finally, the lipid nanoparticles are filtered through a 0.2 μm pore sterile filter. Lipid nanoparticle particle diameter size is determined by quasi-elastic light scattering using a Malvern Zetasizer Nano (Malvern, UK).

Preparation of Polymer-Lipidoid Complexed mRNA 20 mg peptide (CHHHHHHRRRRHHHHHHC—NH2; SEQ ID NO: 1443) TFA salt is dissolved in 2 mL borate buffer pH 8.5 and stirred at room temperature for approximately 18 h. Then, 12.6 mg PEG-SH 5000 (Sunbright) dissolved in N—methylpyrrolidone is added to the peptide solution and filled up to 3 mL with borate buffer pH 8.5. After 18 h incubation at room temperature, the reaction mixture is purified and concentrated by centricon procedure (MWCO 10 kDa), washed against water, and lyophilized. The obtained lyophilisate is dissolved in ELGA water and the concentration of the polymer is adjusted to 10 mg/mL. The obtained polyethylene glycol/peptide polymers (HO-PEG 5000—S—(S—CHHHHHHRRRRHHHHHHC—S—)7—S—PEG 5000—OH—amino acid component: SEQ ID NO: 1443) are used for further formulation and are hereinafter referred to as PB83.

Preparation of 3-C12—OH lipidoid: First, lipidoid 3-C12 was obtained by acylation of tris(2-aminoethyl)amine with an activated lauric (C12) acid derivative, followed by reduction of the amide. Alternatively, it may be prepared by reductive amination with the corresponding aldehyde. Lipidoid 3-C12—OH was prepared by addition of the terminal C12 alkyl epoxide with the same oligoimine according to Love et al., pp. 1864-1869, PNAS, vol. 107 (2010), no. 5.

Preparation of compositions with nanoparticles of polymer-lipidoid complexed mRNA: First, ringer lactate buffer (Rita; alternatively e.g. saline (NaCl) or PBS buffer may be used), respective amounts of lipidoid, and respective amounts of a polymer (PB83) are mixed to prepare compositions comprising a lipidoid and a peptide or polymer. Then, the carrier compositions are used to assemble nanoparticles with the mRNA by mixing the mRNA with respective amounts of polymer-lipidoid carrier and allowing an incubation period of 10 minutes at room temperature such as to enable the formation of a complex between the lipidoid, polymer and mRNA. In order to characterize the integrity of the obtained polymer-lipidoid complexed mRNA particles, RNA agarose gel shift assays are performed. In addition, size measurements are performed (gel shift assay, Zetasizer) to evaluate whether the obtained nanoparticles have a uniform size profile.

Example 7: Vaccination of Mice and Evaluation of Specific Immune Response

Female BALB/c mice are injected intramuscularly (i.m.) with respective mRNA vaccine compositions (prepared according to Example 6) with doses, application routes and vaccination schedules as indicated in Table X3. As a negative control, one group of mice is vaccinated with buffer (ringer lactate). All animals are vaccinated on day 1, 21 and 35. Blood samples are collected on day 21, 35, and 63 for the determination of binding and neutralizing antibody titers (see below).

TABLE X3

Vaccination regimen - Nipah virus experiment (Example 7)

| Number of mice | Vaccine composition | Route/Volume | Vaccination Schedule (day) |
|---|---|---|---|
| 8 | 5 μg RNA construct R1; LNP formulated | i.m.; 2 × 25 μl | 0/21/35 |
| 8 | 20 μg RNA construct R1; polymer-lipidoid complexed | i.m.; 2 × 25 μl | 0/21/35 |
| 8 | 5 μg RNA construct R2; LNP formulated | i.m.; 2 × 25 μl | 0/21/35 |
| 8 | 20 μg RNA construct R2; polymer-lipidoid complexed | i.m.; 2 × 25 μl | 0/21/35 |

TABLE X3-continued

| Vaccination regimen - Nipah virus experiment (Example 7) | | | |
|---|---|---|---|
| Number of mice | Vaccine composition | Route/Volume | Vaccination Schedule (day) |
| 8 | 5 μg RNA construct R3; LNP formulated | i.m.; 2 × 25 μl | 0/21/35 |
| 8 | 20 μg RNA construct R3; polymer-lipidoid complexed | i.m.; 2 × 25 μl | 0/21/35 |
| 8 | 5 μg RNA construct R4; LNP formulated | i.m.; 2 × 25 μl | 0/21/35 |
| 8 | 20 μg RNA construct R4; polymer-lipidoid complexed | i.m.; 2 × 25 μl | 0/21/35 |
| 8 | 5 μg RNA construct R5; LNP formulated | i.m.; 2 × 25 μl | 0/21/35 |
| 8 | 20 μg RNA construct R5; polymer-lipidoid complexed | i.m.; 2 × 25 μl | 0/21/35 |
| 8 | 5 μg RNA construct R6; LNP formulated | i.m.; 2 × 25 μl | 0/21/35 |
| 8 | 20 μg RNA construct R6; polymer-lipidoid complexed | i.m.; 2 × 25 μl | 0/21/35 |

Determination of IgG1 and IgG2 Antibodies by ELISA:

ELISA performed essentially as described in Example 4.

Determination of Antigen-Specific Humoral Immune Responses Using a Cell Based Assay:

Cell based assay performed essentially as described in Example 5.

Intracellular Cytokine Staining:

Splenocytes from vaccinated mice are isolated according to a standard protocol known in the art. Briefly, isolated spleens are grinded through a cell strainer and washed in PBS/1% FBS followed by red blood cell lysis. After an extensive washing step with PBS/1% FBS splenocytes are seeded into 96-well plates ($2\times10^6$ cells per well). The cells are stimulated with a mixture of four Nipah virus protein specific peptide epitopes (5 μg/ml of each peptide) in the presence of 2.5 μg/ml of an anti-CD28 antibody (BD Biosciences) for 6 hours at 37° C. in the presence of a protein transport inhibitor. After stimulation, cells are washed and stained for intracellular cytokines using the Cytofix/Cytoperm reagent (BD Biosciences) according to the manufacturer's instructions. The following antibodies are used for staining: CD3-FITC (1:100), CD8-PE-Cy7 (1:200), TNF-PE (1:100), IFNγ-APC (1:100) (eBioscience), CD4-BD Horizon V450 (1:200) (BD Biosciences) and incubated with Fcγ-block diluted 1:100. Aqua Dye is used to distinguish live/dead cells (Invitrogen). Cells are acquired using a Canto II flow cytometer (Beckton Dickinson). Flow cytometry data is analyzed using FlowJo software package (Tree Star, Inc.)

Plaque Reduction Neutralization Test (PRNT50):

Sera are analyzed by a plaque reduction neutralization test (PRNT50), performed as commonly known in the art. Briefly, obtained serum samples of vaccinated mice are incubated with MERS coronavirus/MERS-CoV. That mixture is used to infect cultured cells, and the reduction in the number of plaques is determined.

Example 8: Clinical Development of a Nipah Virus and Hendra Virus mRNA Vaccine Composition To demonstrate safety and efficiency of the mRNA vaccine composition(s), a clinical trial (phase I) is initiated. In the clinical trial, a cohort of human volunteers is intradermally or intramuscularly injected for at least two times. In order to assess the safety profile of the vaccine compositions according to the invention, subjects are monitored after administration (vital signs, vaccination site tolerability assessments, hematologic analysis). The efficacy of the immunization is analyzed by determination of virus neutralizing titers (VNT) in sera from vaccinated subjects. Blood samples are collected on day 0 as baseline and after completed vaccination. Sera are analyzed for virus neutralizing antibodies.

SEQUENCE LISTING (2378 sequences)

SEQ ID NO: 1 - protein, 1353 aa, Artificial Sequence
  derived and/or modified protein sequence (wt) from MERS-CoV__AFS88936__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFQKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 2 - protein, 1353 aa, Artificial Sequence
  derived and/or modified protein sequence (wt) from MERS-CoV__AFY13307__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRFLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFHKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 3 - protein, 1353 aa, Artificial Sequence
  derived and/or modified protein sequence (wt) from MERS-CoV__AGH58717__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATVTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNYCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSILSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFQKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDSANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 4 - protein, 1353 aa, Artificial Sequence
  derived and/or modified protein sequence (wt) from MERS-CoV__AGN52936__S
MIHSVFLLMFLLTPTESYVDVGPDSIKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFHKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 5 - protein, 1353 aa, Artificial Sequence
  derived and/or modified protein sequence (wt) from MERS-CoV__AGN70951__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPHVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 6 - protein, 1353 aa, Artificial Sequence
  derived and/or modified protein sequence (wt) from MERS-CoV__AGV08408__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSGDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 7 - protein, 1353 aa, Artificial Sequence
  derived and/or modified protein sequence (wt) from MERS-CoV__AGV08455__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSYGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 8 - protein, 1353 aa, Artificial Sequence
  derived and/or modified protein sequence (wt) from MERS-CoV__AGV08467__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSIGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 9 - protein, 1353 aa, Artificial Sequence
  derived and/or modified protein sequence (wt) from MERS-CoV__AGV08492__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVSQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPHVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 10 - protein, 1353 aa, Artificial Sequence
  derived and/or modified protein sequence (wt) from MERS-CoV__AGV08584__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTAWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 11 - protein, 1353 aa, Artificial Sequence
  derived and/or modified protein sequence (wt) from MERS-CoV__AHB33326__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAAYSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMHQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYSPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 12 - protein, 1353 aa, Artificial Sequence
  derived and/or modified protein sequence (wt) from MERS-CoV__AHC74088__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSFAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 13 - protein, 1353 aa, Artificial Sequence
  derived and/or modified protein sequence (wt) from MERS-CoV__AHI48528__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPPAIASNCYSSLILDYFSYPLSMKSDLSVSSAGPISQFNYKQSFSNPTCLILVTVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 14 - protein, 1353 aa, Artificial Sequence
  derived and/or modified protein sequence (wt) from MERS-CoV__AHI48550__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFHKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLQPHKVHVH

SEQ ID NO: 15 - protein, 1353 aa, Artificial Sequence
  derived and/or modified protein sequence (wt) from MERS-CoV__AHI48583__S
MIHSVFLLMFLLTPTESYVDVGPDSVKSACIEVDIQQTFFDKTWPRPIDVFKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFHKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 16 - protein, 1353 aa, Artificial Sequence
  derived and/or modified protein sequence (wt) from MERS-CoV__AHI48605__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFHKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 17 - protein, 1353 aa, Artificial Sequence
  derived and/or modified protein sequence (wt) from MERS-CoV__AHY21469__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATVTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNYCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSILSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSTSTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFQKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDSANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 18 - protein, 1353 aa, Artificial Sequence
  derived and/or modified protein sequence (wt) from MERS-CoV__AHZ64057__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHIFSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINRALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 19 - protein, 1353 aa, Artificial Sequence
  derived and/or modified protein sequence (wt) from MERS-CoV__AID50418__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 20 - protein, 1353 aa, Artificial Sequence
  derived and/or modified protein sequence (wt) from MERS-CoV__AID55068__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINRALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 21 - protein, 1353 aa, Artificial Sequence
  derived and/or modified protein sequence (wt) from MERS-CoV__AID55073__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNFTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 22 - protein, 1353 aa, Artificial Sequence
  derived and/or modified protein sequence (wt) from MERS-CoV__AIY60528__S
MIHSVFLLMFLLTPTESYVDVGPDSFKSACIEVDIQQTFFDKTWPRPIDVSKADGIIYPQGRTYSNITITYQGLFPYQGDHGDMYVYSAGHATGTTPQKLFVANYSQNVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYSPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 23 - protein, 1353 aa, Artificial Sequence
  derived and/or modified protein sequence (wt) from MERS-CoV__AIY60558__S
MIHSVFLLMFLLTPTESYVDVGPDSFKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYSPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 24 - protein, 1353 aa, Artificial Sequence
  derived and/or modified protein sequence (wt) from MERS-CoV__AIZ74450__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMHQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYSPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 25 - protein, 1353 aa, Artificial Sequence
  derived and/or modified protein sequence (wt) from MERS-CoV__AJD81440__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIINPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 26 - protein, 1353 aa, Artificial Sequence
  derived and/or modified protein sequence (wt) from MERS-CoV__AKI29284__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCAFFILCCTGCGTNCMGKLKCNRCCDRYEEYDLEPHKVHVH

SEQ ID NO: 27 - protein, 1353 aa, Artificial Sequence
  derived and/or modified protein sequence (wt) from MERS-CoV__AKL59401__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTRATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSILPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 28 - protein, 1353 aa, Artificial Sequence
  derived and/or modified protein sequence (wt) from MERS-CoV__AKM76229__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSPLTPRSVRSVPGEMRLASIAFNHPIQVDQLNSSYFKLSIPTNFSFGVTQEYIQTTIQKVTVDCKQYICNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYSPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 29 - protein, 1353 aa, Artificial Sequence
  derived and/or modified protein sequence (wt) from MERS-CoV__AKM76239__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTELPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYICNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDVANPTNCIAPVNGYFIKTNNTRIVDEWSYTGSSFYSPEPITSLNTKYVAPQVTYQNISTNLPPPLLGNSTGIDFQDELDEFFKNFSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 30 - protein, 1353 aa, Artificial Sequence
  derived and/or modified protein sequence (wt) from MERS-CoV__AKN11072__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSTVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 31 - protein, 1353 aa, Artificial Sequence
  derived and/or modified protein sequence (wt) from MERS-CoV__AKN11074__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSTVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQHFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 32 - protein, 1353 aa, Artificial Sequence
  derived and/or modified protein sequence (wt) from MERS-CoV__AKN24803__S
MVHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNFTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVSPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 33 - protein, 1353 aa, Artificial Sequence
  derived and/or modified protein sequence (wt) from MERS-CoV__AKN24812__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFCVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNFTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPCSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKSNRCCDRYEEYDLEPHKVHVH

SEQ ID NO: 34 - protein, 1353 aa, Artificial Sequence
  derived and/or modified protein sequence (wt) from MERS-CoV__AKN24830__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNFTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGPTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 35 - protein, 1353 aa, Artificial Sequence
  derived and/or modified protein sequence (wt) from MERS-CoV__ALB08257__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIRRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 36 - protein, 1353 aa, Artificial Sequence
  derived and/or modified protein sequence (wt) from MERS-CoV__ALB08311__S
MIHSVFLLMFLLTPTESYVDVGPDSVKSACIEVDIQQTFFDKTWPRPIDVSKADGIIYPQGRTYSNITITYQGLFPYQGDHGDMYVYSAGYATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDGRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 37 - protein, 1353 aa, Artificial Sequence
  derived and/or modified protein sequence (wt) from MERS-CoV__ALB08322__S
MIHSVFLLMFLLTPTESYVDVGPDSVKSACIEVDIQQTFFDKTWPRPIDVSKADGIIYPQGRTYSNITITYQGLFPYQGDHGDMYVYSAGYATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDGRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLELHKVHVH

SEQ ID NO: 38 - protein, 1353 aa, Artificial Sequence
  derived and/or modified protein sequence (wt) from MERS-CoV__ALD51904__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCAKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 39 - protein, 1353 aa, Artificial Sequence
  derived and/or modified protein sequence (wt) from MERS-CoV__ALJ54446__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNFYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFICSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 40 - protein, 1353 aa, Artificial Sequence
  derived and/or modified protein sequence (wt) from MERS-CoV__ALJ54448__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNAILNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 41 - protein, 1353 aa, Artificial Sequence
  derived and/or modified protein sequence (wt) from MERS-CoV__ALJ54450__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRYASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLSNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 42 - protein, 1353 aa, Artificial Sequence
  derived and/or modified protein sequence (wt) from MERS-CoV__ALJ54453__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNYCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 43 - protein, 1353 aa, Artificial Sequence
  derived and/or modified protein sequence (wt) from MERS-CoV__ALJ54455__S
MIHSVFLLMFLLTPTESYVDVGPDSVKSACIAVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSKLKRRDSTYGPLQTPVGCVLGLVNSSLFVEDCKLPLGQSLCALPDTPSTLKPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 44 - protein, 1353 aa, Artificial Sequence
  derived and/or modified protein sequence (wt) from MERS-CoV__ALJ54456__S
MIHSVFLLMFLLTPTESYVDVGPDSVKSACIAVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLKPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 45 - protein, 1353 aa, Artificial Sequence
  derived and/or modified protein sequence (wt) from MERS-CoV__ALJ54461__S
MIHSVFLLMFLLTPTESYVDVGPDSVKPACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVTSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTSVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 46 - protein, 1353 aa, Artificial Sequence
  derived and/or modified protein sequence (wt) from MERS-CoV__ALJ54468__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFICSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 47 - protein, 1353 aa, Artificial Sequence
  derived and/or modified protein sequence (wt) from MERS-CoV__ALJ54471__S
MIHSVYLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTHINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 48 - protein, 1353 aa, Artificial Sequence
  derived and/or modified protein sequence (wt) from MERS-CoV__ALJ54472__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVLQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLAPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVSQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 49 - protein, 1353 aa, Artificial Sequence
  derived and/or modified protein sequence (wt) from MERS-CoV__ALJ54474__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPSTDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRVVDEWSYTGSSFYAPEPITSLNTKYVAPQVTYQNISTNLPPPLLSNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 50 - protein, 1353 aa, Artificial Sequence
  derived and/or modified protein sequence (wt) from MERS-CoV__ALJ54483__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPIFQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 51 - protein, 1353 aa, Artificial Sequence
  derived and/or modified protein sequence (wt) from MERS-CoV__ALJ54486__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRYASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVVSGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLSNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 52 - protein, 1353 aa, Artificial Sequence
  derived and/or modified protein sequence (wt) from MERS-CoV__ALJ54488__S
MIHSVFLLMFLLTPTESYVDVGPDSVKSACIEVDIQQTFFDKTWPRPIDVSKADGIIYPQGRTYSNITITYQGLFPYQGDHGDIYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 53 - protein, 1353 aa, Artificial Sequence
  derived and/or modified protein sequence (wt) from MERS-CoV__ALJ54490__S
MIHSVFLLMFLLTPTESYVDVGPDSVKSACIAVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDGRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLKPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 54 - protein, 1353 aa, Artificial Sequence
  derived and/or modified protein sequence (wt) from MERS-CoV__ALJ54495__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVVSGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGIHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 55 - protein, 1353 aa, Artificial Sequence
  derived and/or modified protein sequence (wt) from MERS-CoV__ALJ54496__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLPSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDDWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 56 - protein, 1353 aa, Artificial Sequence
  derived and/or modified protein sequence (wt) from MERS-CoV__ALJ54500__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSLLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 57 - protein, 1353 aa, Artificial Sequence
  derived and/or modified protein sequence (wt) from MERS-CoV__ALJ54501__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTLWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 58 - protein, 1353 aa, Artificial Sequence
  derived and/or modified protein sequence (wt) from MERS-CoV__ALJ54502__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASVRDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKFNRCCDRYEEYDLEPHKVHVH

SEQ ID NO: 59 - protein, 1353 aa, Artificial Sequence
  derived and/or modified protein sequence (wt) from MERS-CoV__ALJ54512__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGAHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 60 - protein, 1353 aa, Artificial Sequence
  derived and/or modified protein sequence (wt) from MERS-CoV__ALJ54517__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGNYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTRIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 61 - protein, 1353 aa, Artificial Sequence
  derived and/or modified protein sequence (wt) from MERS-CoV__ALJ54518__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLPSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 62 - protein, 1353 aa, Artificial Sequence
  derived and/or modified protein sequence (wt) from MERS-CoV__ALW82691__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLRSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 63 - protein, 1353 aa, Artificial Sequence
  derived and/or modified protein sequence (wt) from MERS-CoV__ALW82742__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIQKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 64 - protein, 1353 aa, Artificial Sequence
  derived and/or modified protein sequence (wt) from MERS-CoV__ALW82753__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPSTDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVGQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLSNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 65 - protein, 1353 aa, Artificial Sequence
  derived and/or modified protein sequence (wt) from MERS-CoV__ALX27228__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWKDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVSCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 66 - protein, 1353 aa, Artificial Sequence
  derived and/or modified protein sequence (wt) from MERS-CoV__ALX27232__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSYGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIDVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 67 - protein, 1353 aa, Artificial Sequence
  derived and/or modified protein sequence (wt) from MERS-CoV__AMQ48993__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSIVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCITPVNGYFIKTNNTRIVDEWSYTGSSFYAPEPITSLNTKYVAPQVTYQNISTNLPPPLLSNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 68 - protein, 1353 aa, Artificial Sequence
  derived and/or modified protein sequence (wt) from MERS-CoV__AMW90844__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITFQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 69 - protein, 1353 aa, Artificial Sequence
  derived and/or modified protein sequence (wt) from MERS-CoV__AMW90852__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNFTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDDFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 70 - protein, 1353 aa, Artificial Sequence
  derived and/or modified protein sequence (wt) from MERS-CoV__AMW90853__S
MIHSVFLLMFLLTPTESYVDVGSDSVKSACIEVDIQQTFFDKTWPRPIDVSKADGIIYPQGRTYSNITITYQGLFPYQGDHGDMYVYSAGYATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNFTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 71 - protein, 1353 aa, Artificial Sequence
  derived and/or modified protein sequence (wt) from MERS-CoV__ANC28656__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDGRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 72 - protein, 1353 aa, Artificial Sequence
  derived and/or modified protein sequence (wt) from MERS-CoV__ANC28678__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSICSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDGRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 73 - protein, 1352 aa, Artificial Sequence
  derived and/or modified protein sequence (wt) from MERS-CoV__AHL18090__S
MIHSVFLLMFLLTPTESYVDVGLDSAKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNYCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAISSNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKKTKTHATLFGSVACEHISSTMSQYSRSTRSTLKRRDSTYGPLQTPVGCVLGLVNSSLFVEDCKLPLGQSLCALPDTPSTLTPRSVRSVPGQMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSSRIAIEDLLFDKVTIADPGYMQGYDDCMQQGPSSARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFQKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDSANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYKWPWYIWLGFIAGLVALALCVFFILCCTGCGTNCMGKLKRNRCCDRYEEYDLEPHKVHVH

SEQ ID NO: 74 - protein, 1353 aa, Artificial Sequence
  derived and/or modified protein sequence (wt) from MERS-CoV__AHX00731__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLGVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQFNSSYFKLSIPTNFSFGVTQEYIQTTIQKVTVDCKQYICNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYSPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 75 - protein, 1353 aa, Artificial Sequence
  derived and/or modified protein sequence (wt) from MERS-CoV__AHX71946__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSHTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 76 - protein, 1353 aa, Artificial Sequence
  derived and/or modified protein sequence (wt) from MERS-CoV__AHY22545__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFNRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 77 - protein, 1353 aa, Artificial Sequence
  derived and/or modified protein sequence (wt) from MERS-CoV__AHY22555__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNYTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWASFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNSNQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFHKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 78 - protein, 1353 aa, Artificial Sequence
  derived and/or modified protein sequence (wt) from MERS-CoV__AHY22565__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSAIIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWASFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDASNPTNCIAPVNGYFIKTNNTRIVDEWSYTGSSFYSPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 79 - protein, 1353 aa, Artificial Sequence
  derived and/or modified protein sequence (wt) from MERS-CoV__AJG44069__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPRKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSPLTPRSVRSVPGEMRLASIAFNHPIQVDQLNSSYFKLSIPTNFSFGVTQEYIQTTIQKVTVDCKQYICNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYSPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 80 - protein, 1353 aa, Artificial Sequence
  derived and/or modified protein sequence (wt) from MERS-CoV__AJG44080__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIKSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSPLTPRSVRSVPGEMRLASIAFNHPIQVDQLNSSYFKLSIPTNFSFGVTQEYIQTTIQKVTVDCKQYICNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYSPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 81 - protein, 1353 aa, Artificial Sequence
  derived and/or modified protein sequence (wt) from MERS-CoV__AJG44102__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVSHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTISQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYSPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 82 - protein, 1353 aa, Artificial Sequence
  derived and/or modified protein sequence (wt) from MERS-CoV__AJG44124__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMFQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYSPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 83 - protein, 1353 aa, Artificial Sequence
  derived and/or modified protein sequence (wt) from MERS-CoV__ALL26396__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLSVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLSNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 84 - protein, 1353 aa, Artificial Sequence
  derived and/or modified protein sequence (wt) from MERS-CoV__ALS20350__S
MIHSVFLLMFLLTPTESYVDVGPDSAKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNYCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVTVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSYQSSPIIPGFGGDFNLTLLEPVSISTGSRSARSAIEDLLFDKVTIADPGYMQGYDDCMHQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFQKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDLANPTNCIAPVNGYFIKTNNTRIVDEWSYTGSSFYAPEPITSFNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 85 - protein, 1353 aa, Artificial Sequence
  derived and/or modified protein sequence (wt) from MERS-CoV__ALT66880__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYSPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 86 - protein, 1353 aa, Artificial Sequence
  derived and/or modified protein sequence (wt) from MERS-CoV__ALA49341__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTLQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFICSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 87 - protein, 1353 aa, Artificial Sequence
  derived and/or modified protein sequence (wt) from MERS-CoV__ALA49352__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYYTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 88 - protein, 1353 aa, Artificial Sequence
  derived and/or modified protein sequence (wt) from MERS-CoV__ALA49363__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATFPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 89 - protein, 1353 aa, Artificial Sequence
  derived and/or modified protein sequence (wt) from MERS-CoV__ALA49374__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNFTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLSNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 90 - protein, 1353 aa, Artificial Sequence
  derived and/or modified protein sequence (wt) from MERS-CoV__ALA49396__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSSSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLSNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 91 - protein, 1353 aa, Artificial Sequence
  derived and/or modified protein sequence (wt) from MERS-CoV__ALA49451__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCNLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 92 - protein, 1353 aa, Artificial Sequence
  derived and/or modified protein sequence (wt) from MERS-CoV__ALA49473__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPTTDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKFNRCCDRYEEYDLEPHKVHVH

SEQ ID NO: 93 - protein, 1353 aa, Artificial Sequence
  derived and/or modified protein sequence (wt) from MERS-CoV__ALA49583__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKFNRCCDRYEEYDLEPHKVHVH

SEQ ID NO: 94 - protein, 1353 aa, Artificial Sequence
  derived and/or modified protein sequence (wt) from MERS-CoV__ALA49649__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPKKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAIPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYHNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLSNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 95 - protein, 1353 aa, Artificial Sequence
  derived and/or modified protein sequence (wt) from MERS-CoV__ALA49660__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKFYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSDNQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLSNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 96 - protein, 1353 aa, Artificial Sequence
  derived and/or modified protein sequence (wt) from MERS-CoV__ALA49671__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATNCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSDNQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLSNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 97 - protein, 1353 aa, Artificial Sequence
  derived and/or modified protein sequence (wt) from MERS-CoV__ALA49682__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLSNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 98 - protein, 1353 aa, Artificial Sequence
  derived and/or modified protein sequence (wt) from MERS-CoV__ALA49803__S
MIHSVFLLMFLLTPTESYVDVGPDSVKSACIEVDIQQTFFDKTWPRPIDVSKADGIIYPQGRTYSNITITYQGLFPYQGDHGDRYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPSTDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRVVDEWSYTGSSFYAPEPITSLNTKYVAPQVTYQNISTNLPPPLLSNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 99 - protein, 1353 aa, Artificial Sequence
  derived and/or modified protein sequence (wt) from MERS-CoV__ALA49836__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSSSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 100 - protein, 1353 aa, Artificial Sequence
  derived and/or modified protein sequence (wt) from MERS-CoV__ALA49957__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTTIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 101 - protein, 1353 aa, Artificial Sequence
  derived and/or modified protein sequence (wt) from MERS-CoV__ALA50067__S
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSSGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFRKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLSNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 102 - protein, 82 aa, Artificial Sequence
  derived and/or modified protein sequence (wt) from MERS-CoV__AGH58723__E
MLPFVQERIGLFIVNFFIFTVVCAITLLVCMAFLTATRLCVQCMTGFNTLLVQPALYLYNTGRSVYVKFQDSKPPLPPDEWV

SEQ ID NO: 103 - protein, 82 aa, Artificial Sequence
  derived and/or modified protein sequence (wt) from MERS-CoV__AGV08472__E
MLPFVQERVGLFIVNFFIFTVVCAITLLVCMAFLTATRLCVQCMTGFNTLLVQPALYLYNTGRSVYVKFQDSKPPLPPDEWV

SEQ ID NO: 104 - protein, 82 aa, Artificial Sequence
  derived and/or modified protein sequence (wt) from MERS-CoV__AGV08540__E
MLPFVQERIGLFIVKFFIFTVVCAITLLVCMAFLTATRLCVQCMTGFNTLLVQPALYLYNTGRSVYVKFQDSKPPLPPDEWV

SEQ ID NO: 105 - protein, 82 aa, Artificial Sequence
  derived and/or modified protein sequence (wt) from MERS-CoV__ALX27237__E
MLPFVQERIGLFIVNFFIFTVVCAITLLVCMAFLTATRLCVQCMTGFNTLLVQPALYLYNTGRSVYVKFQDSKPPLPSDEWV

SEQ ID NO: 106 - protein, 82 aa, Artificial Sequence
  derived and/or modified protein sequence (wt) from MERS-CoV__ALR69646__E
MLPFVQERIGLFIVNFFIFTVVCAITLLVCMAFLTATRLCVQCITGFNTLLVQPALYLYNTGRSVYVKFQDSKPPLPPDEWV

SEQ ID NO: 107 - protein, 82 aa, Artificial Sequence
  derived and/or modified protein sequence (wt) from MERS-CoV__ALA49346__E
MLPFVQERIGLFIVNFSIFTVVCAITLLVCMAFLTATRLCVQCMTGFNTLLVQPALYLYNTGRSVYVKFQDSKPPLPPDEWV

SEQ ID NO: 108 - protein, 82 aa, Artificial Sequence
  derived and/or modified protein sequence (wt) from MERS-CoV__ALA49390__E
MLPFVQERIGLFIVNFFIFTVVCAITLLVCMAFLTATRLCVQCMTGLNTLLVQPALYLYNTGRSVYVKFQDSKPPLPPDEWV

SEQ ID NO: 109 - protein, 219 aa, Artificial Sequence
  derived and/or modified protein sequence (wt) from MERS-CoV__AFS88942__M
MSNMTQLTEAQIIAIIKDWNFAWSLIFLLITIVLQYGYPSRSMTVYVFKMFVLWLLWPSSMALSIFSAVYPIDLASQIISGIVAAVSAMMWISYFVQSIRLFMRTGSWWSFNPETNCLLNVPFGGTTVVRPLVEDSTSVTAVVTNGHLKMAGMHFGACDYDRLPNEVTVAKPNVLIALKMVKRQSYGTNSGVAIYHRYKAGNYRSPPITADIELALLRA

SEQ ID NO: 110 - protein, 219 aa, Artificial Sequence
  derived and/or modified protein sequence (wt) from MERS-CoV__AGH58718__M
MSNMTQLTEAQIIAVIKDWNFAWSLIFLLITIVLQYGYPSRSMTVYVFKMFVLWLLWPSSMALSIFSTVYPIDLASQIISGIVAAVSAMMWISYFVQSIRLFMRTGSWWSFNPETNCLLNVPFGGTTVVRPLVEDSTSVTAVVTNGHLKMAGMHFGACDYDRLPNEVTVAKPNVLIALKMVKRQSYGTNSGVAIYHRYKAGNYRSPPITADIELALLRA

SEQ ID NO: 111 - protein, 219 aa, Artificial Sequence
  derived and/or modified protein sequence (wt) from MERS-CoV__AGV08396__M
MSNMTQLTEAQIIAIIKDWNFAWSLIFLLITIVLQYGYPSRSMTVYVFKMFVLWLLWPSSMALSIFSAIYPIDLASQIISGIVAAVSAMMWISYFVQSIRLFMRTGSWWSFNPETNCLLNVPFGGTTVVRPLVEDSTSVTAVVTNGHLKMAGMHFGACDYDRLPNEVTVAKPNVLIALKMVKRQSYGTNSGVAIYHRYKAGNYRSPPITADIELALLRA

SEQ ID NO: 112 - protein, 219 aa, Artificial Sequence
  derived and/or modified protein sequence (wt) from MERS-CoV__AGV08590__M
MSNMTQLTEAQIIAIIKDWNFVWSLIFLLITIVLQYGYPSRSMTVYVFKMFVLWLLWPSSMALSIFSAVYPIDLASQIISGIVAAVSAMMWISYFVQSIRLFMRTGSWWSFNPETNCLLNVPFGGTTVVRPLVEDSTSVTAVVTNGHLKMAGMHFGACDYDRLPNEVTVAKPNVLIALKMVKRQSYGTNSGVAIYHRYKAGNYRSPPITADIELALLRA

SEQ ID NO: 113 - protein, 219 aa, Artificial Sequence
  derived and/or modified protein sequence (wt) from MERS-CoV__AHI48567__M
MSNMTQLAEAQIIAIIKDWNFAWSLIFLLITIVLQYGYPSRSMTVYVFKMFVLWLLWPSSMALSIFSAVYPIDLASQIISGIVAAVSAMMWISYFVQSIRLFMRTGSWWSFNPETNCLLNVPFGGTTVVRPLVEDSTSVTAVVTNGHLKMAGMHFGACDYDRLPNEVTVAKPNVLIALKMVKRQSYGTNSGVAIYHRYKAGNYRSPPITADIELALLRA

SEQ ID NO: 114 - protein, 219 aa, Artificial Sequence
  derived and/or modified protein sequence (wt) from MERS-CoV__AHI48589__M
MSNMTQLTEAQIIAVIKDWNFAWSLIFLLITIVLQYGYPSRSMTVYVFKMFVLWLLWPSSMALSIFSAIYPIDLASQIISGIVAAVSAMMWISYFVQSIRLFMRTGSWWSFNPETNCLLNVPFGGTTVVRPLVEDSTSVTAVVTNGHLKMAGMHFGACDYDRLPNEVTVAKPNVLIALKMVKRQSYGTNSGVAIYHRYKAGNYRSPPITADIELALLRA

SEQ ID NO: 115 - protein, 219 aa, Artificial Sequence
  derived and/or modified protein sequence (wt) from MERS-CoV__AIL23940__M
MSNMTQLTEAQIIAIIKDWNFAWSLIFLLITIVLQYGYPSRSMTVYVFKMFVLWLLWPSSMALSIFSAIYPIDLASQIISGIVAAVSAMMWISYFVQSIRLFMRTGSWWSFNPETNCLLNVPFGGTTVVRPLVEDSTSVTAVVTNGHLKMAGMHFGACDYDRLPNEVTVAKPNVVIALKMVKRQSYGTNSGVAIYHRYKAGNYRSPPITADIELALLRA

SEQ ID NO: 116 - protein, 219 aa, Artificial Sequence
  derived and/or modified protein sequence (wt) from MERS-CoV__AKM76245__M
MSNITQLTEAQIIAIIKDWNFAWSLIFLLITIVLQYGYPSRSMTVYVFKMFVLWLLWPSSMALSIFSAVYPIDLASQIISGIVAAVSAMMWISYFVQSIRLFMRTGSWWSFNPETNCLLNVPFGGTTVVRPLVEDSTSVTAVVTNGHLKMAGMHFGACDYDRLPNEVTVAKPNVLIALKMVKRQSYGTNSGVAIYHRYKAGNYRSPPITADIELALLRA

SEQ ID NO: 117 - protein, 219 aa, Artificial Sequence
  derived and/or modified protein sequence (wt) from MERS-CoV__ALW82726__M
MSNMTQLTEAQIIAIIKDWHFAWSLIFLLITIVLQYGYPSRSMTVYVFKMFVLWLLWPSSMALSIFSAIYPIDLASQIISGIVAAVSAMMWISYFVQSIRLFMRTGSWWSFNPETNCLLNVPIGGTTVVRPLVEDSTSVTAVVTNGHLKMAGMHFGACDYDRLPNEVTVAKPNVLIALKMVKRQSYGTNSGVAIYHRYKAGNYRSPPITADIELALLRA

SEQ ID NO: 118 - protein, 219 aa, Artificial Sequence
  derived and/or modified protein sequence (wt) from MERS-CoV__ALX27238__M
MSNMTQLTEAQIIAIIKDWSFAWSLIFLLITIVLQYGYPSRSMTVYVFKMFVLWLLWPSSMALSIFSAVYPIDLASQIISGIVAAVSAMMWISYFVQSIRLFMRTGSWWSFNPETNCLLNVPFGGTTVVRPLVEDSTSVTAVVTNGHLKMAGMHFGACDYDRLPNEVTVAKPNVLIALKMVKRQSYGTNSGVAIYHRYKAGNYRSPPITADIELALLRA

SEQ ID NO: 119 - protein, 219 aa, Artificial Sequence
  derived and/or modified protein sequence (wt) from MERS-CoV__AMQ49021__M
MSNMTQLTEAQIIAIIKDWHFAWSLIFLLITIVLQYGYPSRSMTVYVFKMFVLWLLWPSSMALSIFSAIYPIDLASQIISGIVAAVSAMMWISYFVQSIRLFMRTGSWWSFNPETNCLLNVPIGGTTVVRPLVEDSTSVTAVVTNGHLKMAGMHFGACDYDRLSNEVTVAKPNVLIALKMVKRQSYGTNSGVAIYHRYKAGNYRSPPITADIELALLRA

SEQ ID NO: 120 - protein, 219 aa, Artificial Sequence
  derived and/or modified protein sequence (wt) from MERS-CoV__AJG44108__M
MSNMTQLTEAQIIAIIKDWNFAWSLIFLLITIVLQYGYPSRSMTVYVFKMFVLWLLWPSSMALSIFSAFYPIDLASQIISGIVAAVSAMMWISYFVQSIRLFMRTGSWWSFNPETNCLLNVPFGGTTVVRPLVEDSTSVTAVVTNGHLKMAGMHFGACDYDRLPNEVTVAKPNVLIALKMVKRQSYGTNSGVAIYHRYKAGNYRSPPITADIELALLRA

SEQ ID NO: 121 - protein, 219 aa, Artificial Sequence
  derived and/or modified protein sequence (wt) from MERS-CoV__ALA49369__M
MSNMTQLTEAQIIAIIKDWNFAWSLIFLLITIVLQYGYPSRSMTVYVFKMFVLWLLWPSSMALSIFSAIYPIDLASQIISGIVAAVSAMMWISYFVQSIRLFMRTGSWWSFNPETNCLLNVPIGGTTVVRPLVEDSTSVTAVVTNGHLKMAGMHFGACDYDRLPNEVTVAKPNVLIALKMVKRQSYGTNSGVAIYHRYKAGNYRSPPITADIELALLRA

SEQ ID NO: 122 - protein, 219 aa, Artificial Sequence
  derived and/or modified protein sequence (wt) from MERS-CoV__ALA49424__M
MSNMTQLTEAQIIAIIKDWNFAWSLIFLLITIVLQYGYPSRSMTVYVFKMFVLWLLWPSSMALSIFSAIYPIDLASQIISGIVAAVSAMMRISYFVQSIRLFMRTGSWWSFNPETNCLLNVPFGGTTVVRPLVEDSTSVTAVVTNGHLKMAGMHFGACDYDRLPNEVTVAKPNVLIALKMVKRQSYGTNSGVAIYHRYKAGNYRSPPITADIELALLRA

SEQ ID NO: 123 - protein, 219 aa, Artificial Sequence
  derived and/or modified protein sequence (wt) from MERS-CoV__ALA49908__M
MSNMTQLTEAQIIAIIKDWNFAWSLIFLLITIVLQYGYPSRSMTVYVFKMFVLWLLWPSSMALSIFSAIYPIDLSSQIISGIVAAVSAMMWISYFVQSIRLFMRTGSWWSFNPETNCLLNVPFGGTTVVRPLVEDSTSVTAVVTNGHLKMAGMHFGACDYDRLPNEVTVAKPNVLIALKMVKRQSYGTNSGVAIYHRYKAGNYRSPPITADIELALLRA

SEQ ID NO: 124 - protein, 219 aa, Artificial Sequence
  derived and/or modified protein sequence (wt) from MERS-CoV__ALA49963__M
MSNMTQLTEAQIIAIIKDWNFAWSLIFLLITIVLQYGYPSRSMTVYVFKMFVLWLLWPSSMALSIFSAIYPIDLASQIISGIVAAVSAMMWISYFVQSIRLFMRTGSWWSFNPETNCLLNVPIGGTTVVRPLVEDSTSVTAVVTNGHLKMAGMHFGACDYDRLSNEVTVAKPNVLIALKMVKRQSYGTNSGVAIYHRYKAGNYRSPPITADIELALLRA

SEQ ID NO: 125 - protein, 413 aa, Artificial Sequence
  derived and/or modified protein sequence (wt) from MERS-CoV__AFS88943__N
MASPAAPRAVSFADNNDITNTNLSRGRGRNPKPRAAPNNTVSWYTGLTQHGKVPLTFPPGQGVPLNANSTPAQNAGYWRRQDRKINTGNGIKQLAPRWYFYYTGTGPEAALPFRAVKDGIVWVHEDGATDAPSTFGTRNPNNDSAIVTQFAPGTKLPKNFHIEGTGGNSQSSSRASSLSRNSSRSSSQGSRSGNSTRGTSPGPSGIGAVGGDLLYLDLLNRLQALESGKVKQSQPKVITKKDAAAAKNKMRHKRTSTKSFNMVQAFGLRGPGDLQGNFGDLQLNKLGTEDPRWPQIAELAPTASAFMGMSQFKLTHQNNDDHGNPVYFLRYSGAIKLDPKNPNYNKWLELLEQNIDAYKTFPKKEKKQKAPKEESTDQMSEPPKEQRVQGSITQRTRTRPSVQPGPMIDVNTD

SEQ ID NO: 126 - protein, 411 aa, Artificial Sequence [sequence omitted]

SEQ ID NO: 127 - protein, 413 aa, Artificial Sequence
  derived and/or modified protein sequence (wt) from MERS-CoV__AGH58724__N
MASPAAPRAVSFAYNNDITNTNLSRGRGRNPKPRAAPNNTVSWYTGLTQHGKVPLTFPPGQGVPLNANSTPAQNAGYWRRQDRKINTGNGIKQLAPRWYFYYTGTGPEAALPFRAVKDGIVWVHEDGATDAPSTFGTRNPNNDSAIVTQFAPGTKLPKNFHIEGTGGNSQSSSRASSVSRNSSRSSSQGSRSGNSTRGTSPGPSGIGAVGGDLLYLDLLNRLQALESGKVKQSQPKVITKKDAAAAKNKMRHKRTSTKSFNMVQAFGLRGPGDLQGNFGDLQLNKLGTEDPRWPQIAELAPTASAFMGMSQFKLTHQNNDDHGNPVYFLRYSGAIKLDPKNPNYNKWLELLEQNIDAYKTFPKKEKKQKAPKEESTDQMSEPPKEQRVQGSITQRTRTRPSVQPGPMIDVNTD

SEQ ID NO: 128 - protein, 413 aa, Artificial Sequence
  derived and/or modified protein sequence (wt) from MERS-CoV__AGV08397__N
MASPAAPRAVSFADNNDITNTNLSRGRGRNPKPRAAPNNTVSWYTGLTQHGKVPLTFPPGQGVPLNANSTPAQNAGYWRRQDRKINTGNGIKQLAPRWYFYYTGTGPEAALPFRAVKDGIVWVHEDGATDAPSTFGTRNPNNDSAIVTQFAPGTKLPKNFHIEGTGGNSQSSSRASSVSRNSSRSSSQGSRSGNSTRGTSPGPSGIGAVGGDLLYLDLLNRLQALESGKVKQSQPKVITKKDAAAAKNKMRHKRTSTKSFNMVQAFGLRGPGDLQGNFGDLQLNKLGTEDPRWPQIAELAPTASAFMGMSQFKLTHQNNDDHGNPVYFLRYSGAIKLDPKNPNYNKWLELLEQNIDAYKTFPKKEKKQKAPKEELTDQMSEPPKEQRVQGSITQRTRTRPSVQPGPMIDVNTD

SEQ ID NO: 129 - protein, 413 aa, Artificial Sequence
  derived and/or modified protein sequence (wt) from MERS-CoV__AGV08415__N
MASPAAPRAVSFADNNDITNTNLSRGRGRNPKPRAAPNNTVSWYTGLTQHGKVPLTFPPGQGVPLNANSTPAQNAGYWRRQDRKINTGNGIKQLAPRWYFYYTGTGPEAALPFRAVKDGIVWVHEDGATDAPSTFGTRNPNNDSAIVTQFAPGTKLPKNFHIEGTGGNSQSSSRASSVSRNSSRSSSQGSRSGNSTRGTSPGPSGIGAVGGDLLYLDLLNRLQALESGKVKQSQPKVITKKDAAAAKNKMRHKRTSTKSFNMVQAFGLRGPGDLQGNFGDLQLNKLGTEDPRWPQIAELAPTASAFMGMSQFKLTHQNNDDHGNPVYFLRYSGAIKLDPKNPNYNKWLELLEQNIDAYKTFPKKEKKQKAPKEESTDQMSEPPKEQRVQGSITQRTRTRPSVQPGPMIDVNTD

SEQ ID NO: 130 - protein, 413 aa, Artificial Sequence
  derived and/or modified protein sequence (wt) from MERS-CoV__AGV08487__N
MASPAAPRAVSFADNNDITNTNLSRGRGRNPKPRAAPNNTVSWYTGLTQHGKVPLTFPPGQGVPLNANSTPAQNAGYWRRQDRKINTGNGIKQLAPRWYFYYTGTGPEAALPFRAVKDGIVWVHEHGATDAPSTFGTRNPNNDSAIVTQFAPGTKLPKNFHIEGTGGNSQSSSRASSVSRNSSRSSSQGSRSGNSTRGTSPGPSGIGAVGGDLLYLDLLNRLQALESGKVKQSQPKVITKKDAAAAKNKMRHKRTSTKSFNMVQAFGLRGPGDLQGNFGDLQLNKLGTEDPRWPQIAELAPTASAFMGMSQFKLTHQNNDDHGNPVYFLRYSGAIKLDPKNPNYNKWLELLEQNIDAYKTFPKKEKKQKAPKEESTDQMSEPPKEQRVQGSITQRTRTRPSVQPGPMIDVNTD

SEQ ID NO: 131 - protein, 413 aa, Artificial Sequence
  derived and/or modified protein sequence (wt) from MERS-CoV__AHC74095__N
MASPAAPRAVSFADNNDITNTNLSRGRGRNPKPRAAPNNTVSWYTGLTQHGKVPLTFPPGQGVPLNANSTPAQNAGYWRRQDRKINTGNGIKQLAPRWYFYYTGTGPEAALPFRAVKDGIVWVHEDGATDAPSTFGTRNPNNDLAIVTQFAPGTKLPKNFHIEGTGGNSQSSSRASSVSRNSSRSSSQGSRSGNSTRGTSPGPSGIGAVGGDLLYLDLLNRLQALESGKVKQSQPKVITKKDAAAAKNKMRHKRTSTKSFNMVQAFGLRGPGDLQGNFGDLQLNKLGTEDPRWPQIAELAPTASAFMGMSQFKLTHQNNDDHGNPVYFLRYSGAIKLDPKNPNYNKWLELLEQNIDAYKTFPKKEKKQKAPKEESTDQMSEPPKEQRVQGSITQRTRTRPSVQPGPMIDVNTD

SEQ ID NO: 132 - protein, 413 aa, Artificial Sequence
  derived and/or modified protein sequence (wt) from MERS-CoV__AHI48535__N
MASPAAPRAVSFADNNDITNTNLSRGRGRNPKPRAAPNNTVSWYTGLTQHGKVPLTFSPGQGVPLNANSTPAQNAGYWRRQDRKINTGNGIKQLAPRWYFYYTGTGPEAALPFRAVKDGIVWVHEDGATDAPSTFGTRNPNNDSAIVTQFAPGTKLPKNFHIEGTGGNSQSSSRASSVSRNSSRSSSQGSRSGNSTRGTSPGPSGIGAVGGDLLYLDLLNRLQALESGKVKQSQPKVITKKDAAAAKNKMRHKRTSTKSFNMVQAFGLRGPGDLQGNFGDLQLNKLGTEDPRWPQIAELAPTASAFMGMSQFKLTHQNNDDHGNPVYFLRYSGAIKLDPKNPNYNKWLELLEQNIDAYKTFPKKEKKQKAPKEESTDQVSEPPKEQRVQGIITQRTRTRPSVQPGPMIDVNTD

SEQ ID NO: 133 - protein, 413 aa, Artificial Sequence
  derived and/or modified protein sequence (wt) from MERS-CoV__AIL23941__N
MASLAAPRAVSFADNNDITNTNLSRGRGRNPKPRAAPNNTVSWYTGLTQHGKVPLTFPPGQGVPLNANSTPAQNAGYWRRQDRKINTGNGIKQLAPRWYFYYTGTGPEAALPFRAVKDGIVWVHEHGATDAPSTFGTRNPNNDSAIVTQFAPGTKLPKNFHIEGTGGNSQSSSRASSVSRNSSRSSSQGSRSGNSTRGTSPGPSGIGAVGGDLLYLDLLNRLQALESGKVKQSQPKVITKKDAAAAKNKMRHKRTSTKSFNMVQAFGLRGPGDLQGNFGDLQLNKLGTEDPRWPQIAELAPTASAFMGMSQFKLTHQNNDDHGNPVYFLRYSGAIKLDPKNPNYNKWLELLEQNIDAYKTFPKKEKKQKAPKEESTDQMSEPPKEQRVQGSITQRTRTRPSVQPGPMIDVNTD

SEQ ID NO: 134 - protein, 413 aa, Artificial Sequence
  derived and/or modified protein sequence (wt) from MERS-CoV__AIL23996__N
MASPAAPRAVSFADNNDITNTNLSRGRGRNPKPRAAPNNTVSWYTGLTQHGKVPLTFPPGQGVPLNANSTPAQNAGYWRRQDRKINTGNGIKQLAPRWYFYYTGTGPEAALPFRAVKDGIVWVHEDGATDAPSTFGTRNPNNDLAIVTQFAPGTKLPKNFHIEGTGGNSQSSSRASSVSRNSSRSSSQGSRSGNSTRGTSPGPSGIGAVGGDLLYLDLLNRLQALESGKVKQSQPKVITKKDAAAAKNKMRHKRTSTKSFNMVQAFGLRGPGDLQGNFGDLQLNKLGTEDPRWPQIAELAPTASAFMGMSQFKLTHQNNDDHGNPVYFLRYSGAIKLDPKNPNYNKWLELLEQNIDAYKTFPKKEKKQKAPKEESTDQMSEPPKEQRVQGSITQHTRTRPSVQPGPMIDVNTD

SEQ ID NO: 135 - protein, 413 aa, Artificial Sequence
  derived and/or modified protein sequence (wt) from MERS-CoV__AIY60565__N
MAAPAAPRAVSFADNNDITNTNLSRGRGRNPKPRAAPNNTVSWYTGLTQHGKVPLTFPPGQGVPLNANSTPAQNAGYWRRQDRKINTGNGIKQLAPRWYFYYTGTGPEAALPFRAVKDGIVWVHEDGATDAPSTFGTRNPNNDSAIVTQFAPGTKLPKNFHIEGTGGNSQSSSRASSVSRNSSRSSSQGSRSGNSTRGTSPVPSGIGAVGGDLLYLDLLNRLQALESGKVKQSQPKVITKKDAAAAKNKMRHKRTSTKSFNMVQAFGLRGPGDLQGNFGDLQLNKLGTEDPRWPQIAELAPTASAFMGMSQFKLTHQNNDDHGNPVYFLRYSGAIKLDPKNPNYNKWLELLEQNIDAYKTFPKKEKKQKAPKEESTDQMSEPPKEQRVQGSITQRTRTRPSVQPGPMIDVNTD

SEQ ID NO: 136 - protein, 413 aa, Artificial Sequence
  derived and/or modified protein sequence (wt) from MERS-CoV__AIZ74424__N
MAAPAAPRAVSFADNNDITNTNLSRGRGRNPKPRAAPNNTVSWYTGLTQHGKVPLTFPPGQGVPLNANSTPAQNAGYWRRQDRKINTGNGIKQLAPRWYFYYTGTGPEAALPFRAVKDGIVWVHEDGATDAPSTFGTRNPNNDSAIVTQFAPGTKLPKNFHIEGTGGNSQSSSRASSVSRNSSRSSSQGSRSGNSTRGTSPGPSGIGAVGGDLLYLDLLNRLQALESGKVKQSQPKVITKKDAAAAKNKMRHKRTSTKSFNMVQAFGLRGPGDLQGNFGDLQLNKLGTEDPRWPQIAELAPTASAFMGMSQFKLTHQNNDDHGNPVYFLRYSGAIKLDPKNPNYNKWLELLEQNIDAYKTFPKKEKKQKAPKEESTDQMSEPPKEQRVQGSITQRTRTRPSVQPGPMIDVNTD

SEQ ID NO: 137 - protein, 413 aa, Artificial Sequence; identical to SEQ ID NO: 136
  derived and/or modified protein sequence (wt) from MERS-CoV__AIZ74430__N

SEQ ID NO: 138 - protein, 413 aa, Artificial Sequence
  derived and/or modified protein sequence (wt) from MERS-CoV__AKI29291__N
MASPAAPRAVSFADNNDITNTNLSRGRGRNPKPRAAPNNTVSWYTGLTQHGKVPLTFPPGQGVPLNANSTPAQNAGYWRRQDRKINTGNGIKQLAPRWYFYYTGTGPEAALPFRAVKDGIVWVHEDGATDAPSTFGTRNPNNDSAIVTQFAPGTKLPKNFHIEGTGGNSQSSSRASSVSRNSSRSSSQGSRSGNSTRGTSPGPSGIGAVGGDLLYLDLLNRLQALESGKVKQSQPKVITKKDAAAAKNKMRHKRTSTKSFNMVQAFGLRGPGDLQGNFGDLQLNKLGTEDPRWPQIAELAPTASAFMGMSQFKLTHQNNDDHGNPVYFLRYSGAIKLDPKNPNYNKWLELLEQNIDAYKTFPKKEKKQKAPKEESTDQMSEPPKEQRVQGSITQRIRTRPSVQPGPMIDVNTD

SEQ ID NO: 139 - protein, 413 aa, Artificial Sequence
  derived and/or modified protein sequence (wt) from MERS-CoV__AKK52599__N
MASPAAPCAVSFADNNDITNTNLSRGRGRNPKPRAAPNNTVSWYTGLTQHGKVPLTFPPGQGVPLNANSTPAQNAGYWRRQDRKINTGNGIKQLAPRWYFYYTGTGPEAALPFRAVKDGIVWVHEDGATDAPSTFGTRNPNNDSAIVTQFAPGTKLPKNFHIEGTGGNSQSSSRASSVSRNSSRSSSQGSRSGNSTRGTSPGPSGIGAVGGDLLYLDLLNRLQALESGKVKQSQPKVITKKDAAAAKNKMRHKRTSTKSFNMVQAFGLRGPGDLQGNFGDLQLNKLGTEDPRWPQIAELAPTASAFMGMSQFKLTHQNNDDHGNPVYFLRYSGAIKLDPKNPNYNKWLELLEQNIDAYKTFPKKEKKQKAPKEESTDQMSEPPKEQRVQGSITQRTRTRPSVQPGPMIDVNTD

SEQ ID NO: 140 - protein, 413 aa, Artificial Sequence
  derived and/or modified protein sequence (wt) from MERS-CoV__AKN24774__N
MASPAAPRAVSFADNNDITNTNLSRGRGRNPKPRAAPNNTVSWYTGLTQHGKVPLTFPPGQGVPLNANSTPAQNAGYWRRQDRKINTGNGIKQLAPRWYFYYTGTGPEAALPFRAVKDGIVWVHEDGATDAPSTFGTRNPNNDLAIVTQFAPGTKLPKNFHIEGTGGNSQSSSRASSVSRNSSRSSSQGSRSGNSTRGTSPGPSGIGAVGGDLLYLDLLNRLQALESGKVKQSQPKVITKKDAAAAKNKMRHKRTSTKSFNMVQAFGLRGPGDLQGNFGDLQLNKLGTEDPRWPQIAELVPTASAFMGMSQFKLTHQNNDDHGNPVYFLRYSGAIKLDPKNPNYNKWLELLEQNIDAYKTFPKKEKKQKAPKEESTDQMSEPPKEQRVQGSITQHTRTRPSVQPGPMIDVNTD

SEQ ID NO: 141 - protein, 413 aa, Artificial Sequence
  derived and/or modified protein sequence (wt) from MERS-CoV__ALW82676__N
MASPAAPRAVSFADNNDTTNTNLSRGRGRNPKPRAAPNNTVSWYTGLTQHGKVPLTFPPGQGVPLNANSTPAQNAGYWRRQDRKINTGNGIKQLAPRWYFYYTGTGPEAALPFRAVKDGIVWVHEDGATDAPSTFGTRNPNNDSAIVTQFAPGTKLPKNFHIEGTGGNSQSSSRASSVSRNSSRSSSQGSRSGNSTRGTSPGPSGIGAVGGDLLYLDLLNRLQALESGKVKQSQPKVITKKDAAAAKNKMRHKRTSTKSFNMVQAFGLRGPGDLQGNFGDLQLNKLGTEDPRWPQIAELAPTASAFMGMSQFKLTHQNNDDHGNPVYFLRYSGAIKLDPKNPNYNKWLELLEQNIDAYKTFPKKEKKQKAPKEESTDQMSEPPKEQRVQGSITQRTRTRPSVQPGPMIDVNTD

SEQ ID NO: 142 - protein, 413 aa, Artificial Sequence
  derived and/or modified protein sequence (wt) from MERS-CoV__AMQ49033__N
MASPAAPRAVFFADNNDITNTNLSRGRGRNPKPRAAPNNTVSWYTGLTQHGKVPLTFPPGQGVPLNANSTPAQNAGYWRRQDRKINTGNGIKQLAPRWYFYYTGTGPEAALPFRAVKDGIVWVHEDGATDAPSTFGTRNPNNDSAIVTQFAPGTKLPKNFHIEGTGGNSQSSSRASSVSRNSSRSSSQGSRSGNSTRGTSPGPSGIGAVGGDLLYLDLLNRLQALESGKVKQSQPKVITKKDAAAAKNKMRHKRTSTKSFNMVQAFGLRGPGDLQGNFGDLQFNKLGTEDPRWPQIAELAPTASAFMGMSQFKLTHQNNDDHGNPVYFLRYSGAIKLDPKNPNYNKWLELLEQNIDAYKTFPKKEKKQKAPKEESTDQMSEPPKEQRVQGSITQRTRTRPSVQPGPMIDVNTD

SEQ ID NO: 143 - protein, 413 aa, Artificial Sequence
  derived and/or modified protein sequence (wt) from MERS-CoV__AHL18098__N
MASSAAPRAVSFADNNDITNTNLSRGRGRNPKPRAAPNNTVSWYTGLTQHGKVPLTFPPGQGVPLNANSTPAQNAGYWRRQDRKINTGNGIKQLAPRWYFYYTGTGPEAALPFRAVKDGIVWVHEDGATDAPSTFGTRNPNNDSAIVTQFAPGTKLPKNFHIEGTGGNSQSSSRASSVSRNSSRSSSQGSRSGNSTRGTSPGPSGIGAVGGDLLYLDLLNRLQALESGKVKQSQPKVITKKDAAAAKNKMRHKRTSTKSFNMVQAFGLRGPGDLQGNFGDLQLNKLGTEDPRWPQIAELAPTASAFMGMSQFKLTHQNNDDHGNPVYFLRYSGAIKLDPKNPNYNKWLELLEQNIDAYKTFPKKENKQKAPKEESTDQMSEPPKEQRVQGSITQRTRTRPSVQPGPMIDVNTD

SEQ ID NO: 144 - protein, 413 aa, Artificial Sequence
  derived and/or modified protein sequence (wt) from MERS-CoV__AHX00738__N
MAAPAAPRAVSFADNNDITNTNMSRGRGRNPKPRAAPNNTVSWYTGLTQHGKVPLTFPPGQGVPLNANSTPAQNAGYWRRQDRKINTGNGIKQLAPRWYFYYTGTGPEAALPFRAVKDGIVWVHEDGATDAPSTFGTRNPNNDSAIVTQFAPGTKLPKNFHIEGTGGNSQSSSRASSVSRNSSRSSSQGSRSGNSTRGTSPGPSGIGAVGGDLLYLDLLNRLQALESGKVKQSQPKVITKKDAAAAKNKMRHKRTSTKSFNMVQAFGLRGPGDLQGNFGDLQLNKLGTEDPRWPQIAELAPTASAFMGMSQFKLTHQNNDDHGNPVYFLRYSGAIKLDPKNPNYNKWLELLEQNIDAYKTFPKKEKKQKAPKEESTDQMSEPPKEQRVQGSITQRTRTRPSVQPGPMIDVNTD

SEQ ID NO: 145 - protein, 413 aa, Artificial Sequence
  derived and/or modified protein sequence (wt) from MERS-CoV__AHY22561__N
MASPAAPRAVSFADNNDITNTNLSRGRGRNPKPRAAPNNTVSWYTGLTQHGKVPLTFPPGQGVPLNANSTPAQNAGYWRRQDRKINTGNGIKQLAPRWYFYYTGTGPEAALPFRAVKDGIVWVHEDGATDAPSTFGTRNPNNDSAIVTQFAPGTKLPKNFHIEGTGGNSQSSSRASSVSRNSSRSSSQGSRSGNSTRGTSPGPSGIGAVGGDLLYLDLLNRLQALESGKVKQSQPKVITKKDAAAAKNKMRHKRTSTKSFNMVQAFGLRGPGDLQGNFGDLQLNKLGTEDPRWPQIAELAPTASAFMGMSQFKLTHQNNDDHGNPVYFLRYSGAIKLDPKNPNYNKWLELLEQNIDAYKTFPKKENKQKAPKEESTDQMSEPPKEQRVQGSITQRTRTRPSVQPGPMIDVNTD

SEQ ID NO: 146 - protein, 413 aa, Artificial Sequence
  derived and/or modified protein sequence (wt) from MERS-CoV__AHY22571__N
MAAPAAPRAVSFADNNDITNTNLSRGRGRNPKPRAAPNNTVSWYTGLTQHGKVPLTFPPGQGVPLNANSTPAQNAGYWRRQDRKINTGNGIKQLAPRWYFYYTGTGPEAALPFRAVKDGIVWVHEDGATDAPSTFGTRNPNNDSAIVTQFAPGTKLPKNFHIEGTGGNSQSSSRASSVSRNSSRSSSQGSRSRNSTRGTSPGPSGIGAVGGDLLYLDLLNRLQALESGKVKQSQPKVITKKDAAAAKNKMRHKRTSTKSFNMVQAFGLRGPGDLQGNFGDLQLNKLGTEDPRWPQIAELAPTASAFMGMSQFKLTHQNNDDHGNPVYFLRYSGAIKLDPKNPNYNKWLELLEQNIDAYKTFPKKENKQKAPKEESTDQMSEPPKEQRVQGSITQRTRTRPSVQPGPMIDVNTD

SEQ ID NO: 147 - protein, 413 aa, Artificial Sequence
  derived and/or modified protein sequence (wt) from MERS-CoV__ALA49381__N
MASPAAPRAVSFADNNDITNTNLSRGRGRNPKPRAAPNNTVSWYTGLTQHGKVPLTFPPGQGVPLNANSTPAQNAGYWRRQDRKINTGNGIKQLAPRWYFYYTGTGPEAALPFRAVKDGIVWVHEDGATDAPSTFGTRNPNNDSAIVTQFAPGTKLPKNFHIEGTGGNSQSSSRASSVSRNSSRSSSQGSRSGNSTRGSSPGPSGIGAVGGDLLYLDLLNRLQALESGKVKQSQPKVITKKDAAAAKNKMRHKRTSTKSFNMVQAFGLRGPGDLQGNFGDLQLNKLGTEDPRWPQIAELAPTASAFMGMSQFKLTHQNNDDHGNPVYFLRYSGAIKLDPKNPNYNKWLELLEQNIDAYKTFPKKEKKQKAPKEESTDQMSEPPKEQRVQGSITQRTRTRPSVQPGPMIDVNTD

SEQ ID NO: 148 - protein, 413 aa, Artificial Sequence
  derived and/or modified protein sequence (wt) from MERS-CoV__ALA49392__N
MASPAAPRAVSFADNNDITNTNLSRGRGRNPKPRAAPNNTVSWYTGLTQHGKVPLTFPPGQGVPLNANSTPAQNAGYWRRQDRKINTGNGIKQLAPRWYFYYTGTGPEAALPFRAVKDGIVWVHEDGATDAPSTFGTRNPNNDSAIVTQFAPGTKLPKNFHIEGTGGNSQSSSRASSVSRNSSRSSSQGSRSGNSTRGSSPGPSGIGAVGGDLLYLDLLNRLQALESGKVKQSQPKVITKKDAAAAKNKMRHKRTSTKSFNMVQAFGLRGPGDLQGNFGDLQLNKLGTEDPRWPQIAELAPTASAFMGMSQFKLTHQNNDDHGNPVYFLRYSGAIKLDPKNPNYNKWLELLEQNIDAYKTFPKKEKKQKAPKEESTDQMSEPPKEQRVRGSITQRTRTRPSVQPGPMIDVNTD

SEQ ID NO: 149 - protein, 413 aa, Artificial Sequence
  derived and/or modified protein sequence (wt) from MERS-CoV__ALA49601__N
MASPAAPRAVSFADNNDITNTNLSRGRGRNPKPRAAPNNTVSWYTGLTQHGKVPLTFPPGQGVPLNANSTPAQNAGYWRRQDRKINTGNGIKQLAPRWYFYYTGTGPEAALPFRAVKDGIVWVHEDGATDAPSTFGTRNPNNDSAIVTQFAPGTKLPKNFHIEGTGGNSQSSSRASSVSRNSSRSSSQGSRSGNSTRGTSPGLSGIGAVGGDLLYLDLLNRLQALESGKVKQSQPKVITKKDAAAAKNKMRHKRTSTKSFNMVQAFGLRGPGDLQGNFGDLQLNKLGTEDPRWPQIAELAPTASAFMGMSQFKLTHQNNDDHGNPVYFLRYSGAIKLDPKNPNYNKWLELLEQNIDAYKTFPKKEKKQKAPKEESTDQMSEPPKEQRVQGSITQRTRTRPSVQPGPMIDVNTD

SEQ ID NO: 150 - protein, 413 aa, Artificial Sequence
  derived and/or modified protein sequence (wt) from MERS-CoV__ALA49843__N
MASPAAPRAVSFADNNDITNTNLSRGRGRNPKPRAAPNNTVSWYTGLTQHGKVPLTFPPGQGVPLNANSTPAQNAGYWRRQDRKINTGNGIKQLAPRWYFYYTGTGPEAALPFRAVKDGIVWVHEDGATDAPSTFGTRNPNNDSAIVTQFAPGTKLPKNFHIEGTGGNSQSSSRASSVSRNSSRSSSQGSRSGNSTRCTSPGPSGIGAVGGDLLYLDLLNRLQALESGKVKQSQPKVITKKDAAAAKNKMRHKRTSTKSFNMVQAFGLRGPGDLQGNFGDLQLNKLGTEDPRWPQIAELAPTASAFMGMSQFKLTHQNNDDHGNPVYFLRYSGAIKLDPKNPNYNKWLELLEQNIDAYKTFPKKEKKQKAPKEESTDQMSEPPKEQRVQGSITQRTRTRPSVQPGPMIDVNTD

SEQ ID NO: 151 - protein, 413 aa, Artificial Sequence
  derived and/or modified protein sequence (wt) from MERS-CoV__ALA49865__N
MASPAAPRAVSFADNNDITNTNLSRGRGRNPKPRAAPNNTVSWYTGLTQHGKVPLTFPPGQGVPLNANSTPAQNAGYWRRQDRKINTGNGIKQLAPRWYFYYIGTGPEAALPFRAVKDGIVWVHEDGATDAPSTFGTRNPNNDSAIVTQFAPGTKLPKNFHIEGTGGNSQSSSRASSVSRNSSRSSSQGSRSGNSTRGTSPGPSGIGAVGGDLLYLDLLNRLQALESGKVKQSQPKVITKKDAAAAKNKMRHKRTSTKSFNMVQAFGLRGPGDLQGNFGDLQLNKLGTEDPRWPQIAELAPTASAFMGMSQFKLTHQNNDDHGNPVYFLRYSGAIKLDPKNPNYNKWLELLEQNIDAYKTFPKKEKKQKAPKEESTDQMSEPPKEQRVQGSITQRTRTRPSVQPGPMIDVNTD

SEQ ID NO: 152 - protein, 413 aa, Artificial Sequence
  derived and/or modified protein sequence (wt) from MERS-CoV__ALA49909__N
MASPAAPRAVSFADNNDITNTNLSRGRGRNPKPRAAPNNTVSWYTGLTQHGKVPLTFPPGQGVPLNANSTPAQNAGYWRRQDRKINTGNGIKQLAPRWYFYYTGTGPEAALPFRAVKDGIVWVHEHGATDAPSTFGTRNPNNDSAIVTQFAPGTKLPKNFHIEGTGGNSQSSSRASSVSRNSSRSSSQGSRSGNSTRCTSPGPSGIGAVGGDLLYLDLLNRLQALESGKVKQSQPKVITKKDAAAAKNKMRHKRTSTKSFNMVQAFGLRGPGDLQGNFGDLQLNKLGTEDPRWPQIAELAPTASAFMGMSQFKLTHQNNDDHGNPVYFLRYSGAIKLDPKNPNYNKWLELLEQNIDAYKTFPKKEKKQKAPKEESTDQMSEPPKEQRVQGSITQRTRTRPSVQPGPMIDVNTD

SEQ ID NO: 153 - RNA, 4062 nt, Artificial Sequence
  derived and/or modified CDS sequence (wt) from MERS-CoV__AFS88936__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauugcaugcagcaagguccagcaucagcucgugaucuuauuugugcucaauauguggcugguuacaaaguauuaccuccucuuauggauguuaauauggaagccgcguauacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucagaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccauuaccucccuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucccuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 154 - RNA, 4062 nt, Artificial Sequence
  derived and/or modified CDS sequence (wt) from MERS-CoV__AFY13307__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuaguaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucguuuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauugcaugcagcaagguccagcaucagcucgugaucuuauuugugcucaauauguggcugguuacaaaguauuaccuccucuuauggauguuaauauggaagccgcguauaccucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucacaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuucggcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 155 - RNA, 4062 nt, Artificial Sequence
  derived and/or modified CDS sequence (wt) from MERS-CoV__AGH58717__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacagucacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaauuauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucuuucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauugcaugcagcaagguccagcaucagcucgugaucuuauuugugcucaauauguggcugguuacaaaguauuaccuccucuuauggauguuaauauggaagccgcguauacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucagaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcgcagcagcuuguucguuccgaaucagcugcucuuucggcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgauucagcuaacccuacuaauuguauagccccuguuaauggcuacuuuauuaaaacuaauaacacuaggauuguugaugaguggucauauacuggcucguccuucuaugcaccugagcccaucaccucccuuaauacuaaguauguugcaccacaggugacauaccaaaacauuucuacuaaccucccuccuccucuucuuggcaauuccaccgggauugacuuccaagaugaguuggaugaguuuuucaaaaauguuagcaccaguauaccuaauuuugguucucuaacacagauuaauacuacauuacucgaucuuaccuaugagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 156 - RNA, 4062 nt, Artificial Sequence
  derived and/or modified CDS sequence (wt) from MERS-CoV__AGN52936__S
augauacacucaguguuucuacugauguucuuguuaacaccuacagaaaguuacguugauguagggccagauucuauuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucauacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauugcaugcagcaagguccagcaucagcucgugaucuuauuugugcucaauauguggcugguuacaaaguauuaccuccucuuauggauguuaauauggaagccgcguauaccucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucacaagguucaggaugcugugaacaacaaugcacaggcucuauccaaauuagcuagcgagcuaucuaauacuuuuggugcuauuuccgccucuauuggagacaucauacaacgucuugauguucucgaacaggaugcccaaauagacagacuuauuaauggccguuugacaacacuaaaugcuuuuguugcacagcagcuuguucguuccgaaucagcugcucuuucggcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucccuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 157 - RNA, 4062 nt, Artificial Sequence
  derived and/or modified CDS sequence (wt) from MERS-CoV__AGN70951__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguucgcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguccuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcauaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucuguuccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuuguggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucccuuaauacuaaguauguugcaccacaugugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 158 - RNA, 4062 nt, Artificial Sequence
  derived and/or modified CDS sequence (wt) from MERS-CoV__AGV08408__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucuggugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucuguuccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucccuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 159 - RNA, 4062 nt, Artificial Sequence
  derived and/or modified CDS sequence (wt) from MERS-CoV__AGV08455__S
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucauaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucugugccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 160 - RNA, 4062 nt, Artificial Sequence
  derived and/or modified CDS sequence (wt) from MERS-CoV__AGV08467__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucuguuccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucccuuaauacuaaguauguugcaccacaggugacauaccaaaacauuucuacuaaccucccuccuccucuucucggcaauuccauugggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 161 - RNA, 4062 nt, Artificial Sequence
  derived and/or modified CDS sequence (wt) from MERS-CoV__AGV08492__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguucgcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguccuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcauaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucuguuccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguuucacagcagcuuguucguuccgaaucagcugcucuuuccgcucaauuggcuaaagauaaagucaaugagugugucaaggcacaauccaagcguucuggauuuuguggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucccuuaauacuaaguauguugcaccacaugugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 162 - RNA, 4062 nt, Artificial Sequence
  derived and/or modified CDS sequence (wt) from MERS-CoV__AGV08584__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugcgugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucuguuccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucccuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 163 - RNA, 4062 nt, Artificial Sequence
  derived and/or modified CDS sequence (wt) from MERS-CoV__AHB33326__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccuauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugacacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucuguuccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcaucaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuauucaccugagcccaucaccucccuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 164 - RNA, 4062 nt, Artificial Sequence
  derived and/or modified CDS sequence (wt) from MERS-CoV__AHC74088__S
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguuuugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucugugccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagauagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgacgcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 165 - RNA, 4062 nt, Artificial Sequence
  derived and/or modified CDS sequence (wt) from MERS-CoV__AHI48528__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguucgcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguccuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccaccagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagugacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucuguuccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuuguggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucccuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 166 - RNA, 4062 nt, Artificial Sequence
  derived and/or modified CDS sequence (wt) from MERS-CoV__AHI48550__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauugcaugcagcaagguccagcaucagcucgugaucuuauuugugcucaauauguggcugguuacaaaguauuaccuccucuuauggauguuaauauggaagccgcguauaccucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucacaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuucggcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccuccagccgcauaagguucauguucacuaa

SEQ ID NO: 167 - RNA, 4062 nt, Artificial Sequence
  derived and/or modified CDS sequence (wt) from MERS-CoV__AHI48583__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuuuuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauugcaugcagcaagguccagcaucagcucgugaucuuauuugugcucaauauguggcugguuacaaaguauuaccuccucuuauggauguuaauauggaagccgcguauaccucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucacaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuucggcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 168 - RNA, 4062 nt, Artificial Sequence
  derived and/or modified CDS sequence (wt) from MERS-CoV__AHI48605__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaauaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucuguuccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauugcaugcagcaagguccagcaucagcucgugaucuuauuugugcucaauauguggcugguuacaaaguauuaccuccucuuauggauguuaauauggaagccgcguauaccucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucacaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuucggcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 169 - RNA, 4062 nt, Artificial Sequence
  derived and/or modified CDS sequence (wt) from MERS-CoV__AHY21469__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacagucacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaauuauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucuuucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuacaucuacuggcagucguagugcacguagugcuauugaggauuugcuauuugacaaagucacuauagcugauccugguuauaugcaagguuacgaugauugcaugcagcaagguccagcaucagcucgugaucuuauuugugcucaauauguggcugguuacaaaguauuaccuccucuuauggauguuaauauggaagccgcguauacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucagaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcgcagcagcuuguucguuccgaaucagcugcucuuucggcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgauucagcuaacccuacuaauuguauagccccuguuaauggcuacuuuauuaaaacuaauaacacuaggauuguugaugaguggucauauacuggcucguccuucuaugcaccugagcccaucaccucccuuaauacuaaguauguugcaccacaggugacauaccaaaacauuucuacuaaccucccuccuccucuucuuggcaauuccaccgggauugacuuccaagaugaguuggaugaguuuuucaaaaauguuagcaccaguauaccuaauuuugguucucuaacacagauuaauacuacauuacucgaucuuaccuaugagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 170 - RNA, 4062 nt, Artificial Sequence
  derived and/or modified CDS sequence (wt) from MERS-CoV__AHZ64057__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuucucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccgggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauugcaugcagcaagguccagcaucagcucgugaucuuauuugugcucaauauguggcugguuacaaaguauuaccuccucuuauggauguuaauauggaagccgcguauaccucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 171 - RNA, 4062 nt, Artificial Sequence
  derived and/or modified CDS sequence (wt) from MERS-CoV__AID50418__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguccuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugcuaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauaugguccucuucagacaccuguugguuguguccuaggacuuguuaauuccucuuuguucguagaggacugcaaguugccucucggucaaucucucugugcucuuccugacacaccuaguacucucacaccucgcagugugcgcucuguuccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucccuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 172 - RNA, 4062 nt, Artificial Sequence
  derived and/or modified CDS sequence (wt) from MERS-CoV__AID55068__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccgggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauugcaugcagcaagguccagcaucagcucgugaucuuauuugugcucaauauguggcugguuacaaaguauuaccuccucuuauggauguuaauauggaagccgcguauaccucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 173 - RNA, 4062 nt, Artificial Sequence
  derived and/or modified CDS sequence (wt) from MERS-CoV__AID55073__S
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaauuuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucuguuccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 174 - RNA, 4062 nt, Artificial Sequence
  derived and/or modified CDS sequence (wt) from MERS-CoV__AIY60528__S
augauacacucaguguuucuacugauguucuuguuaacaccuacagaaaguuacguugauguagggccagauucuuuuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucagaacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaagcggcgagauucuacauauggcccccuucagacaccuguugguuguguccuaggacuuguuaauuccucuuuguucguagaggacugcaaguugccucucggucaaucucucugugcucuuccugacacaccuaguacucuuacaccucgcagugugcgcucuguuccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacauuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuauucaccugagcccaucaccucccuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 175 - RNA, 4062 nt, Artificial Sequence
  derived and/or modified CDS sequence (wt) from MERS-CoV__AIY60558__S
augauacacucaguguuucuacugauguucuuguuaacaccuacagaaaguuacguugauguagggccagauucuuuuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucacaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaagcggcgagauucuacauauggcccccuucagacaccuguugguuguguccuaggacuuguuaauuccucuuuguucguagaggacugcaaguugccucucggucaaucucucugugcucuuccugacacaccuaguacucuuacaccucgcagugugcgcucuguuccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacauuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuauucaccugagcccaucaccucccuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 176 - RNA, 4062 nt, Artificial Sequence
  derived and/or modified CDS sequence (wt) from MERS-CoV__AIZ74450__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugacacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucuguuccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcaucaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuauucaccugagcccaucaccucccuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 177 - RNA, 4062 nt, Artificial Sequence
  derived and/or modified CDS sequence (wt) from MERS-CoV__AJD81440__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuaacccaucuaccagcgcuacuauacgaaaaauuuacccugcuuuuaugcuggguucuucaguugguaauuucucagaugguaaaaugggccgcuucuucaaucauacucuaguccuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugcuaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauaugguccucuucagacaccuguugguuguguccuaggacuuguuaauuccucuuuguucguagaggacugcaaguugccucucggucaaucucucugugcucuuccugacacaccuaguacucucacaccucgcagugugcgcucuguuccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucccuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 178 - RNA, 4062 nt, Artificial Sequence
  derived and/or modified CDS sequence (wt) from MERS-CoV__AKI29284__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauugcaugcagcaagguccagcaucagcucgugaucuuauuugugcucaauauguggcugguuacaaaguauuaccuccucuuauggauguuaauauggaagccgcguauaccucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgccuucuucauacugugcugcacugguuguggcacaaacuguaugggaaaacuuaaguguaaucguuguugugauagauacgaggaauacgaccucgagccgcauaagguucauguucacuaa

SEQ ID NO: 179 - RNA, 4062 nt, Artificial Sequence
  derived and/or modified CDS sequence (wt) from MERS-CoV__AKL59401__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuacccgcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauucucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugacguucucgaacaggacgcccaaauagacagacuuauuaauggccguuugacaacacuaaaugcuuuuguugcacagcagcuuguucguucugaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 180 - RNA, 4062 nt, Artificial Sequence
  derived and/or modified CDS sequence (wt) from MERS-CoV__AKM76229__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguccucuuacaccucgcagugugcgcucuguuccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacauuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucucggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgcuucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuauucaccugagcccaucaccucccuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuuuauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 181 - RNA, 4062 nt, Artificial Sequence
  derived and/or modified CDS sequence (wt) from MERS-CoV__AKM76239__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucuaaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaauuaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucuuacaccucgcagugugcgcucuguuccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacauuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgcuucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgauguagcuaacccuacuaauuguauagccccuguuaauggcuacuuuauuaaaacuaauaacacuaggauuguugaugaguggucauauacuggcucguccuucuauucaccugagcccaucaccucccuuaauacuaaguauguugcaccacaggugacauaccaaaacauuucuacuaaccucccuccuccucuucucggcaauuccaccgggauugacuuccaagaugaguuggaugaguuuuucaaaaauuuuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuuuauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 182 - RNA, 4062 nt, Artificial Sequence
  derived and/or modified CDS sequence (wt) from MERS-CoV__AKN11072__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccacugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccguggugucuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugacguucucgaacaggacgcccaaauagacagacuuauuaauggccguuugacaacacuaaaugcuuuuguugcacagcagcuuguucguucugaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 183 - RNA, 4062 nt, Artificial Sequence
  derived and/or modified CDS sequence (wt) from MERS-CoV__AKN11074__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccacugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccguggugucuuucagaauugcacagcuguagguguucgacagcagcacuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugacguucucgaacaggacgcccaaauagacagacuuauuaauggccguuugacaacacuaaaugcuuuuguugcacagcagcuuguucguucugaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 184 - RNA, 4062 nt, Artificial Sequence
  derived and/or modified CDS sequence (wt) from MERS-CoV__AKN24803__S
augguacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaauuuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuucccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucuguuccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 185 - RNA, 4062 nt, Artificial Sequence
  derived and/or modified CDS sequence (wt) from MERS-CoV__AKN24812__S
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucugcguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaauuuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuugcagugugcgcucuguuccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggaccgcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaagucuaaucguuguugugauagauacgaggaauacgaccucgagccgcauaagguucauguucacuaa

SEQ ID NO: 186 - RNA, 4062 nt, Artificial Sequence
  derived and/or modified CDS sequence (wt) from MERS-CoV__AKN24830__S
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaauuuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcccaacuguugccaugacugagcaauuacagaugggcuuugguauuacaguucaauaugguacagacaccaauaguguuugccccaagcuugaauuugcuaaugacacaaaaauugccucucaauuaggcaauugcguggaauacucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucuguuccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucagcaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 187 - RNA, 4062 nt, Artificial Sequence
  derived and/or modified CDS sequence (wt) from MERS-CoV__ALB08257__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccguggugucuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacgacgucuugacguucucgaacaggacgcccaaauagacagacuuauuaauggccguuugacaacacuaaaugcuuuuguugcacagcagcuuguucguucugaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 188 - RNA, 4062 nt, Artificial Sequence
  derived and/or modified CDS sequence (wt) from MERS-CoV__ALB08311__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggauaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugauggucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccguggugucuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugacguucucgaacaggacgcccaaauagacagacuuauuaauggccguuugacaacacuaaaugcuuuuguugcacagcagcuuguucguucugaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 189 - RNA, 4062 nt, Artificial Sequence
  derived and/or modified CDS sequence (wt) from MERS-CoV__ALB08322__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggauaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugauggucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccguggugucuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugacguucucgaacaggacgcccaaauagacagacuuauuaauggccguuugacaacacuaaaugcuuuuguugcacagcagcuuguucguucugaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagcugcauaagguucauguucacuaa

SEQ ID NO: 190 - RNA, 4062 nt, Artificial Sequence
  derived and/or modified CDS sequence (wt) from MERS-CoV__ALD51904__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuugugccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauugcaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 191 - RNA, 4062 nt, Artificial Sequence
  derived and/or modified CDS sequence (wt) from MERS-CoV__ALJ54446__S
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuucuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccaccucagguuuauaauuuuaagcguuugguuuuuaccaauugcaauuauaaucuuaccaaauugcuuucacuuuuuucugugaaugauuuuauuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucucuguucguagaggacugcaaguugccucucggucaaucucucugugcucuuccugacacaccuaguacucucacaccucgcagugugcgcucugugccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuuuauugcugggcuuguugccuuagcucuaugcgucuucuucauacugugcugcacugguuguggcacaaacuguaugggaaaacuuaaguguaaucguuguugugauagauacgaggaauacgaccucgagccacauaagguucauguucacuaa

SEQ ID NO: 192 - RNA, 4062 nt, Artificial Sequence
  derived and/or modified CDS sequence (wt) from MERS-CoV__ALJ54448__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccauucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 193 - RNA, 4062 nt, Artificial Sequence
  derived and/or modified CDS sequence (wt) from MERS-CoV__ALJ54450__S
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguuaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucugugccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucagcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuauauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 194 - RNA, 4062 nt, Artificial Sequence
  derived and/or modified CDS sequence (wt) from MERS-CoV__ALJ54453__S
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaauuauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucugugccaggugaaaugcgcuuggcauccauugcuuuuaaucaucccauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 195 - RNA, 4062 nt, Artificial Sequence
  derived and/or modified CDS sequence (wt) from MERS-CoV__ALJ54455__S
augauacacucaguguuucuacugauguucuuguuaacaccuacagaaaguuacguugauguagggccagauucuguuaagucugcuuguauugcgguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaagcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucaaaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 196 - RNA, 4062 nt, Artificial Sequence
  derived and/or modified CDS sequence (wt) from MERS-CoV__ALJ54456__S
augauacacucaguguuucuacugauguucuuguuaacaccuacagaaaguuacguugauguagggccagauucuguuaagucugcuuguauugcgguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucaaaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 197 - RNA, 4062 nt, Artificial Sequence
  derived and/or modified CDS sequence (wt) from MERS-CoV__ALJ54461__S
augauacacucaguguuucuacugauguucuuguuaacaccuacagaaaguuacguugauguagggccagauucuguuaagccugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugccaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuacuucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugcaucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaucuguugguuguguccuaggacuuguuaauuccucuuuguucguagaggacugcaaguugccucucggucaaucucucugugcucuuccugacacaccuaguacucucacaccucgcagugugcgcucuguuccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 198 - RNA, 4062 nt, Artificial Sequence
  derived and/or modified CDS sequence (wt) from MERS-CoV__ALJ54468__S
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuuuaagcguuugguuuuuaccaauugcaauuauaaucuuaccaaauugcuuucacuuuuuucugugaaugauuuuauuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucucuguucguagaggacugcaaguugccucucggucaaucucucugugcucuuccugacacaccuaguacucucacaccucgcagugugcgcucugugccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccagaacauuucuacuaaccucccuccgccucuucuaggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuuuauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 199 - RNA, 4062 nt, Artificial Sequence
  derived and/or modified CDS sequence (wt) from MERS-CoV__ALJ54471__S
augauacacucaguguaucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucucucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacauauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 200 - RNA, 4062 nt, Artificial Sequence
  derived and/or modified CDS sequence (wt) from MERS-CoV__ALJ54472__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucucuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucuacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucgcaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauugcaugcagcaagguccagcaucagcucgugaucuuauuugugcucaauauguggcugguuacaaaguauuaccuccucuuauggauguuaauauggaagccgcguauaccucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguuucacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 201 - RNA, 4062 nt, Artificial Sequence
  derived and/or modified CDS sequence (wt) from MERS-CoV__ALJ54474__S
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccuucaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucugugccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggguuguugaugaguggucauauacuggcucguccuucuaugcaccugagcccaucaccucucuuaauacuaaguauguugcaccacaggugacauaccaaaacauuucuacuaaccucccuccuccucuucucagcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuauauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 202 - RNA, 4062 nt, Artificial Sequence
  derived and/or modified CDS sequence (wt) from MERS-CoV__ALJ54483__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauauuccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 203 - RNA, 4062 nt, Artificial Sequence
  derived and/or modified CDS sequence (wt) from MERS-CoV__ALJ54486__S
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuauucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguuaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguuguuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucugugccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucagcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuauauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 204 - RNA, 4062 nt, Artificial Sequence
  derived and/or modified CDS sequence (wt) from MERS-CoV__ALJ54488__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauuuaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuaccaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 205 - RNA, 4062 nt, Artificial Sequence
  derived and/or modified CDS sequence (wt) from MERS-CoV__ALJ54490__S
augauacacucaguguuucuacugauguucuuguuaacaccuacagaaaguuacguugauguagggccagauucuguuaagucugcuuguauugcgguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugauggucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucaaaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 206 - RNA, 4062 nt, Artificial Sequence
  derived and/or modified CDS sequence (wt) from MERS-CoV__ALJ54495__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugccugauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguuguuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggcggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcauacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 207 - RNA, 4062 nt, Artificial Sequence
  derived and/or modified CDS sequence (wt) from MERS-CoV__ALJ54496__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuuccuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaagguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugauuggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 208 - RNA, 4062 nt, Artificial Sequence
  derived and/or modified CDS sequence (wt) from MERS-CoV__ALJ54500__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucauaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucacuucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaauauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 209 - RNA, 4062 nt, Artificial Sequence
  derived and/or modified CDS sequence (wt) from MERS-CoV__ALJ54501__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacuuugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 210 - RNA, 4062 nt, Artificial Sequence
  derived and/or modified CDS sequence (wt) from MERS-CoV__ALJ54502__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacuguucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucaguucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguuuaaucguuguugugauagauacgaggaauacgaccucgagccgcauaagguucauguucacuaa

SEQ ID NO: 211 - RNA, 4062 nt, Artificial Sequence
  derived and/or modified CDS sequence (wt) from MERS-CoV__ALJ54512__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaaggugcucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccguggugucuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugacguucucgaacaggacgcccaaauagacagacuuauuaauggccguuugacaacacuaaaugcuuuuguugcacagcagcuuguucguucugaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 212 - RNA, 4062 nt, Artificial Sequence
  derived and/or modified CDS sequence (wt) from MERS-CoV__ALJ54517__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacgguaauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccguggugucuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugacguucucgaacaggacgcccaaauagacagacuuauuaauggccguuugacaacacuaaaugcuuuuguugcacagcagcuuguucguucugaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccaggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 213 - RNA, 4062 nt, Artificial Sequence
  derived and/or modified CDS sequence (wt) from MERS-CoV__ALJ54518__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuuccuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccguggugucuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugacguucucgaacaggacgcccaaauagacagacuuauuaauggccguuugacaacacuaaaugcuuuuguugcacagcagcuuguucguucugaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 214 - RNA, 4062 nt, Artificial Sequence
  derived and/or modified CDS sequence (wt) from MERS-CoV__ALW82691__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucguucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 215 - RNA, 4062 nt, Artificial Sequence
  derived and/or modified CDS sequence (wt) from MERS-CoV__ALW82742__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacaaaaaauuuacccugcuuuuaugcuggguucuucaguugguaauuucucagaugguaaaaugggccgcuucuucaaucauacucuaguucuuuugccugauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 216 - RNA, 4062 nt, Artificial Sequence
  derived and/or modified CDS sequence (wt) from MERS-CoV__ALW82753__S
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccuucaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucugugccaggugaaaugcgcuuggcauccauugcuuuuaaucaucccauucagguuggucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucagcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuauauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 217 - RNA, 4062 nt, Artificial Sequence
  derived and/or modified CDS sequence (wt) from MERS-CoV__ALX27228__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacuguguggaaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguuaguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 218 - RNA, 4062 nt, Artificial Sequence
  derived and/or modified CDS sequence (wt) from MERS-CoV__ALX27232__S
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucauaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucugugccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugacguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 219 - RNA, 4062 nt, Artificial Sequence
  derived and/or modified CDS sequence (wt) from MERS-CoV__AMQ48993__S
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaauuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucugugccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauaaccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucagcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuauauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 220 - RNA, 4062 nt, Artificial Sequence
  derived and/or modified CDS sequence (wt) from MERS-CoV__AMW90844__S
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacauuucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucugugccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 221 - RNA, 4062 nt, Artificial Sequence
  derived and/or modified CDS sequence (wt) from MERS-CoV__AMW90852__S
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggcguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaauuuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucuguuccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugauuuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 222 - RNA, 4062 nt, Artificial Sequence
  derived and/or modified CDS sequence (wt) from MERS-CoV__AMW90853__S
augauacacucaguguuucuacugauguucuuguuaacaccuacagaaaguuacguugauguagggucagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggauaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaauuuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucuguuccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 223 - RNA, 4062 nt, Artificial Sequence
  derived and/or modified CDS sequence (wt) from MERS-CoV__ANC28656__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugauggucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccguggugucuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugacguucucgaacaggacgcccaaauagacagacuuauuaauggccguuugacaacacuaaaugcuuuuguugcacagcagcuuguucguucugaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 224 - RNA, 4062 nt, Artificial Sequence
  derived and/or modified CDS sequence (wt) from MERS-CoV__ANC28678__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauuuguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugauggucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccguggugucuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugacguucucgaacaggacgcccaaauagacagacuuauuaauggccguuugacaacacuaaaugcuuuuguugcacagcagcuuguucguucugaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 225 - RNA, 4059 nt, Artificial Sequence
  derived and/or modified CDS sequence (wt) from MERS-CoV__AHL18090__S
augauacacucaguguuucuacugauguucuuguuaacaccuacagaaaguuacguugauguagggcuagauucugcuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaauuauuguccugcuggcaauuccuauacuucuuuugccacuuaucacacuccugcaacagauuguucugauggcaauuacaaucguaaugccagucugaacucuuuuaaggaguauuuuaauuuacguaacuguaccuuuauguacacuuauaacauuaccgaagaugagauuuuagagugguuuggcauuacacaaacugcucaagguguucaccucuucucuucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuacauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuucacuuguagucaaauaucuccagcagcaauuucuaguaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugacaaaaaaacuaaaacccacgcuacucuauuugguaguguugcaugugaacacauuucuucuaccaugucucaauacucccguucuacgcgaucaacgcuuaaacggcgagauucuacauauggcccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggucaaaugcgcuuggcaucuauugcuuuuaaucauccuauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguaguucacguauugcuauugaggauuugcuauuugacaaagucacuauagcugauccugguuauaugcaagguuacgaugauugcaugcagcaagguccaucaucagcucgugaucuuauuugugcucaauauguggcugguuacaaaguauuaccuccucuuauggauguuaauauggaagccgcguauacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucagaagguucaggaugcugugaacaacaaugcacaggcucuauccaaauuagcuagcgagcuaucuaauacuuuuggugcuauuuccgccucuauuggagacaucauacaacgucuugauguucucgaacaggacgcucaaauagacagacuuauuaauggccguuugacaacacuaaaugcuuuuguugcgcagcagcuuguucguuccgaaucagcugcucuuucggcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgauucagcuaacccuacuaauuguauagccccuguuaauggcuacuuuauuaaaacuaauaacacuaggauuguugaugaguggucauauacuggcucguccuucuaugcaccugagcccaucaccucccuuaauacuaaguauguugcaccacaggugacauaccaaaauauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaaauggccgugguacauuuggcuugguuucauugcugggcuuguugccuuagcucuaugcgucuucuucauacugugcugcacugguuguggcacaaacuguaugggaaaacuuaagcguaaucguuguugugauagauaugaggaauacgaccucgagccgcauaagguucauguucauuaa

SEQ ID NO: 226 - RNA, 4062 nt, Artificial Sequence
  derived and/or modified CDS sequence (wt) from MERS-CoV__AHX00731__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucgguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucuuacaccucgcagugugcgcucuguuccaggugaaaugcgcuuggcauccauugcuuuuaaucaucccauucagguugaucaauuuaauaguaguuauuuuaaauuaaguauacccacuaauuuuuccuuuggugugacucaggaguacauucagacaaccauucagaaaguuacuguugauuguaaacaguacauuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgcuucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuauucaccugagcccaucaccucccuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuuuauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 227 - RNA, 4062 nt, Artificial Sequence
  derived and/or modified CDS sequence (wt) from MERS-CoV__AHX71946__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauucccauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauugcaugcagcaagguccagcaucagcucgugaucuuauuugugcucaauauguggcugguuacaaaguauuaccuccucuuauggauguuaauauggaagccgcguauaccucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 228 - RNA, 4062 nt, Artificial Sequence
  derived and/or modified CDS sequence (wt) from MERS-CoV__AHY22545__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauucuacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaaucguuugguuuuuaccaauugcaauuauaaucuuaccaaauugcuuucacuuuuuucugugaaugauuuuacuuguagucaaauaucuccagcggcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaauaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauugcaugcagcaagguccagcaucagcucgugaucuuauuugugcucaauauguggcugguuacaaaguauuaccuccucuuauggauguuaauauggaagccgcguauaccucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 229 - RNA, 4062 nt, Artificial Sequence
  derived and/or modified CDS sequence (wt) from MERS-CoV__AHY22555__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaauuauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcuuccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacucuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauugcaugcagcaagguccagcaucagcucgugaucuuauuugugcucaauauguggcugguuacaaaguauuaccuccucuuauggauguuaauauggaagccgcguauaccucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucacaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuucggcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacagguaacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 230 - RNA, 4062 nt, Artificial Sequence
  derived and/or modified CDS sequence (wt) from MERS-CoV__AHY22565__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuauuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacgguggcaauauguuucaauuugccaccuugccuguuuaugauacuauuaaguauuacucuaucauuccucacaguauucguucuauccaaagugauagaaaagcuugggcuuccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucuuacaccucgcagugugcgcucuguuccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcaucuaacccuacuaauuguauagccccuguuaauggcuacuuuauuaaaacuaauaacacuaggauuguugaugaguggucauauacuggcucguccuucuauucaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 231 - RNA, 4062 nt, Artificial Sequence
  derived and/or modified CDS sequence (wt) from MERS-CoV__AJG44069__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacgaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcuacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguccucuuacaccucgcagugugcgcucuguuccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacauuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgcuucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuauucaccugagcccaucaccucccuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuuuauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 232 - RNA, 4062 nt, Artificial Sequence
  derived and/or modified CDS sequence (wt) from MERS-CoV__AJG44080__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcuacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuaucaaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguccucuuacaccucgcagugugcgcucuguuccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacauuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgcuucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuauucaccugagcccaucaccucccuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuuuauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 233 - RNA, 4062 nt, Artificial Sequence
  derived and/or modified CDS sequence (wt) from MERS-CoV__AJG44102__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuucucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccauuucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucuuacaccucgcagugugcgcucuguuccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacauuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuauucaccugagcccaucaccucccuuaauacuaaguauguugcaccacaggugacauaccaaaacauuucuacuaaccucccuccuccccuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 234 - RNA, 4062 nt, Artificial Sequence
  derived and/or modified CDS sequence (wt) from MERS-CoV__AJG44124__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccauguuucaauacucccguucuacgcgaucaaugcuuaagcggcgagauucuacauauggcccccuucagacaccuguugguuguguccuaggacuuguuaauuccucuuuguucguagaggacugcaaguugccucucggucaaucucucugugcucuuccugacacaccuaguacucuuacaccucgcagugugcgcucuguuccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacauuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuauucaccugagcccaucacaucccuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 235 - RNA, 4062 nt, Artificial Sequence
  derived and/or modified CDS sequence (wt) from MERS-CoV__ALL26396__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaagcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaacaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagacucuacauaugguccccuucagacaccuguugguuguguccuaggacuuguuaauuccucuuuguccguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauugcaugcagcaagguccagcaucagcucgugaucuuauuugugcucaauauguggcugguuacaaaguauuaccuccucuuauggauguuaauauggaagccgcguauaccucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucagcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 236 - RNA, 4062 nt, Artificial Sequence
  derived and/or modified CDS sequence (wt) from MERS-CoV__ALS20350__S
augauacacucaguguuucuacugauguucuuguuaacaccuacagaaaguuacguugauguagggccagauucugcuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaauuauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuucacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuacuguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuucagaagugugagcaauuacugcgcgaguauggccaguuuuguuccaaaauaaaccaggcgcuccauggugccaauuuacgccaggaugauucuguacguaauuuguuugcgagcgugaaaagcuaucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauugcaugcaucaagguccagcaucagcucgugaucuuauuugugcucaauauguggcugguuacaaaguauuaccuccucuuauggauguuaauauggaagccgcguauacuucaucuuugcuuggcagcauagcagguguuggcuggacugcuggguuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucagaagguucaggaugcugugaacaacaaugcacaggcucuauccaaauuagcuagcgagcuaucuaauaccuuuggugcuauuuccgccucuauuggagacaucauacaacgucuugauguucucgaacaggacgcccaaauagacagacuuauuaauggccguuugacaacacuaaaugcuuuuguugcgcagcagcuuguucguuccgaaucagcugcucuuucggcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgauuuagcuaacccuacuaauuguauagccccuguuaauggcuacuuuauuaaaacuaauaacacuaggauuguugaugaguggucauauacuggcucguccuucuaugcaccugagcccaucaccuccuuuaauacuaaguauguugcaccacaggugacauaccaaaacauuucuacuaaccucccuccuccucuucucggcaauuccaccgggauugacuuucaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaauuguaugggaaaacuuaaguguaaucguuguugugauagauaugaggaauacgaccucgagccgcauaagguucauguucacuaa

SEQ ID NO: 237 - RNA, 4062 nt, Artificial Sequence
  derived and/or modified CDS sequence (wt) from MERS-CoV__ALT66880__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucuuacaccucgcagugugcgcucuguuccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguaucuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacauuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuucaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuauucaccugagcccaucaccucccuuaauacuaaguauguugcaccacaggugacauaccaaaacauuucuacuaaccucccuccuccccuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 238 - RNA, 4062 nt, Artificial Sequence
  derived and/or modified CDS sequence (wt) from MERS-CoV__ALA49341__S
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacucuacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuuuaagcguuugguuuuuaccaauugcaauuauaaucuuaccaaauugcuuucacuuuuuucugugaaugauuuuauuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucugugccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 239 - RNA, 4062 nt, Artificial Sequence
  derived and/or modified CDS sequence (wt) from MERS-CoV__ALA49352__S
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuauuacacuccugcaacagauuguucugauggcaauuacaaucguaaugccagucugaacucuuuuaaggaguauuuuaauuuacguaacugcaccuuuauguacacuuauaacauuacugaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucugugccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauaccuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 240 - RNA, 4062 nt, Artificial Sequence
  derived and/or modified CDS sequence (wt) from MERS-CoV__ALA49363__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuuuccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccgacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 241 - RNA, 4062 nt, Artificial Sequence
  derived and/or modified CDS sequence (wt) from MERS-CoV__ALA49374__S
augauacacucaguguuucuacugauguucuuguuaacaccuacagaaaguuacguugauguagggccagauucuguuaagucugcuuguauugagguugauauacaacagaccuuuuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaauuuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucugugccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucagcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuauauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 242 - RNA, 4062 nt, Artificial Sequence
  derived and/or modified CDS sequence (wt) from MERS-CoV__ALA49396__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccucuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucagcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuauauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 243 - RNA, 4062 nt, Artificial Sequence
  derived and/or modified CDS sequence (wt) from MERS-CoV__ALA49451__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaauuugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 244 - RNA, 4062 nt, Artificial Sequence
  derived and/or modified CDS sequence (wt) from MERS-CoV__ALA49473__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccuacaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguuuaaucguuguugugauagauacgaggaauacgaccucgagccgcauaagguucauguucacuaa

SEQ ID NO: 245 - RNA, 4062 nt, Artificial Sequence
  derived and/or modified CDS sequence (wt) from MERS-CoV__ALA49583__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguuuaaucguuguugugauagauacgaggaauacgaccucgagccgcauaagguucauguucacuaa

SEQ ID NO: 246 - RNA, 4062 nt, Artificial Sequence
  derived and/or modified CDS sequence (wt) from MERS-CoV__ALA49649__S
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccaaaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaauaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccauaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucugugccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucagcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuauauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 247 - RNA, 4062 nt, Artificial Sequence
  derived and/or modified CDS sequence (wt) from MERS-CoV__ALA49660__S
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaauuuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucugugccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguauuuuuuauagguuaaacgguguuggcauuacucaacagguucuuucagauaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucagcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuauauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 248 - RNA, 4062 nt, Artificial Sequence
  derived and/or modified CDS sequence (wt) from MERS-CoV__ALA49671__S
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacaaauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucugugccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguauuuuuuauagguuaaacgguguuggcauuacucaacagguucuuucagauaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucagcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuauauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 249 - RNA, 4062 nt, Artificial Sequence
  derived and/or modified CDS sequence (wt) from MERS-CoV__ALA49682__S
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucugugccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucagcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuauauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 250 - RNA, 4062 nt, Artificial Sequence
  derived and/or modified CDS sequence (wt) from MERS-CoV__ALA49803__S
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauagguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccuucaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucugugccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggguuguugaugaguggucauauacuggcucguccuucuaugcaccugagcccaucaccucucuuaauacuaaguauguugcaccacaggugacauaccaaaacauuucuacuaaccucccuccuccucuucucagcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguugucaaagcccuuaaugagucuuauauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 251 - RNA, 4062 nt, Artificial Sequence
  derived and/or modified CDS sequence (wt) from MERS-CoV__ALA49836__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccucuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 252 - RNA, 4062 nt, Artificial Sequence
  derived and/or modified CDS sequence (wt) from MERS-CoV__ALA49957__S
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcccuuccugacacaccuaguacucucacaccucgcagugugcgcucuguuccaggugaaaugcgcuuggcauccauugcuuuuaaucauccuauucagguugaucaacuuaauaguaguuauuuuaaauuaaguauaccuacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguacacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuacgauuguugaugaguggucauauacuggcucguccuucuaugcaccugagcccaucaccucucuuaauacuaaguauguugcaccacaggugacauaccaaaacauuucuacuaaccucccuccuccucuucucggcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuacauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 253 - RNA, 4062 nt, Artificial Sequence
  derived and/or modified CDS sequence (wt) from MERS-CoV__ALA50067__S
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucuucugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccucgcagugugcgcucugugccaggugaaaugcgcuuggcauccauugcuuuuaaucaucccauucagguugaucaacuuaauaguaguuauuuuaaauuaaguauacccacuaauuuuuccuuuggugugacucaggaguacauucagacaaccauucagaaaguuacuguugauuguaaacaguacguuugcaaugguuuccagaagugugagcaauuacugcgcgaguauggccaguuuuguuccaaaauaaaccaggcucuccauggugccaauuuacgccaggaugauucuguacguaauuuguuugcgagcgugaaaagcucucaaucaucuccuaucauaccagguuuuggaggugacuuuaauuugacacuucuagaaccuguuucuauaucuacuggcagucguagugcacguagugcuauugaggauuugcuauuugacaaagucacuauagcugauccugguuauaugcaagguuacgaugauuguaugcagcaagguccagcaucagcucgugaucuuauuugugcucaauauguggcugguuauaaaguauuaccuccucuuauggauguuaauauggaagccgcguauacuucaucuuugcuuggcagcauagcagguguuggcuggacugcuggcuuauccuccuuugcugcuauuccauuugcacagaguauuuuuuauagguuaaacgguguuggcauuacucaacagguucuuucagagaaccaaaagcuuauugccaauaaguuuaaucaggcucugggagcuaugcaaacaggcuucacuacaacuaaugaagcuuuucggaagguucaggaugcugugaacaacaaugcacaggcucuauccaaauuagcuagcgagcuaucuaauacuuuuggugcuauuuccgccucuauuggagacaucauacaacgucuugauguucucgaacaggacgcccaaauagacagacuuauuaauggccguuugacaacacuaaaugcuuuuguugcacagcagcuuguucguuccgaaucagcugcucuuuccgcucaauuggcuaaagauaaagucaaugagugugucaaggcacaauccaagcguucuggauuuugcggucaaggcacacauauaguguccuuuguuguaaaugccccuaauggccuuuacuuuaugcauguugguuauuacccuagcaaccacauugagguuguuucugcuuauggucuuugcgaugcagcuaacccuacuaauuguauagccccuguuaauggcuacuuuauuaaaacuaauaacacuaggauuguugaugaguggucauauacuggcucguccuucuaugcaccugagcccaucaccucucuuaauacuaaguauguugcaccacaggugacauaccaaaacauuucuacuaaccucccuccuccucuucucagcaauuccaccgggauugacuuccaagaugaguuggaugaguuuuucaaaaauguuagcaccaguauaccuaauuuugguucucuaacacagauuaauacuacauuacucgaucuuaccuacgagauguugucucuucaacaaguuguuaaagcccuuaaugagucuuauauagaccuuaaagagcuuggcaauuauacuuauuacaacaaauggccgugguacauuuggcuugguuucauugcugggcuuguugccuuagcucuaugcgucuucuucauacugugcugcacugguuguggcacaaacuguaugggaaaacuuaaguguaaucguuguugugauagauacgaggaauacgaccucgagccgcauaagguucauguucacuaa

SEQ ID NO: 254 - RNA, 249 nt, Artificial Sequence
  derived and/or modified CDS sequence (wt) from MERS-CoV__AGH58723__E
auguuacccuuuguccaagaacgaauaggguuguucauaguaaacuuuuucauuuuuaccguaguaugugcuauaacacucuugguguguauggcuuuccuuacggcuacuagauuaugugugcaauguaugacaggcuucaauacccuguuaguucagcccgcauuauacuuguauaauacuggacguucagucuauguaaaauuccaggauaguaaacccccucuaccaccugacgaguggguuuaa

SEQ ID NO: 255 - RNA, 249 nt, Artificial Sequence
  derived and/or modified CDS sequence (wt) from MERS-CoV__AGV08472__E
auguuacccuuuguccaagaacgaguaggguuguucauaguaaacuuuuucauuuuuaccguaguaugugcuauaacacucuugguguguauggcuuuccuuacggcuacuagauuaugugugcaauguaugacaggcuucaauacccuguuaguucagcccgcauuauacuuguauaauacuggacguucagucuauguaaaauuccaggauaguaaacccccucuaccaccugacgaguggguuuaa

SEQ ID NO: 256 - RNA, 249 nt, Artificial Sequence
  derived and/or modified CDS sequence (wt) from MERS-CoV__AGV08540__E
auguuacccuuuguccaagaacgaauaggguuguucauaguaaaauuuuucauuuuuaccguaguaugugcuauaacacucuugguguguauggcuuuccuuacggcuacuagauuaugugugcaauguaugacaggcuucaauacccuguuaguucagcccgcauuauacuuguauaauacuggacguucagucuauguaaaauuccaggauaguaaacccccucuaccaccugacgaguggguuuaa

SEQ ID NO: 257 - RNA, 249 nt, Artificial Sequence
  derived and/or modified CDS sequence (wt) from MERS-CoV__ALX27237__E
auguuacccuuuguccaagaacgaauaggguuguucauaguaaacuuuuucauuuuuaccguaguaugugcuauaacacucuugguguguauggcuuuccuuacggcuacuagauuaugugugcaauguaugacaggcuucaauacccuguuaguucagcccgcauuauacuuguauaauacuggacguucagucuauguaaaauuccaggauaguaaacccccucuaccaucugacgaguggguuuaa

SEQ ID NO: 258 - RNA, 249 nt, Artificial Sequence
  derived and/or modified CDS sequence (wt) from MERS-CoV__ALR69646__E
auguuacccuuuguccaagaacgaauaggguuguucauaguaaacuuuuucauuuuuaccguaguaugugcuauaacacucuugguguguauggcuuuccuuacggcuacuagauuaugugugcaauguauuacaggcuucaauacccuguuaguucagcccgcauuauacuuguauaauacuggacguucagucuauguaaaauuccaggauaguaaacccccucuaccaccugacgaguggguuuaa

SEQ ID NO: 259 - RNA, 249 nt, Artificial Sequence
  derived and/or modified CDS sequence (wt) from MERS-CoV__ALA49346__E
auguuacccuuuguccaagaacgaauaggguuguucauaguaaacuuuuccauuuuuaccguaguaugugcuauaacacucuugguguguauggcuuuccuuacggcuacuagauuaugugugcaauguaugacaggcuucaauacccuguuaguucagcccgcauuauacuuguauaauacuggacguucagucuauguaaaauuccaggauaguaaacccccucuaccaccugacgaguggguuuaa

SEQ ID NO: 260 - RNA, 249 nt, Artificial Sequence
  derived and/or modified CDS sequence (wt) from MERS-CoV__ALA49390__E
auguuacccuuuguccaagaacgaauaggguuguucauaguaaacuuuuucauuuuuaccguaguaugugcuauaacacucuugguguguauggcuuuccuuacggcuacuagauuaugugugcaauguaugacaggucucaauacccuguuaguucagcccgcauuauacuuguauaauacuggacguucagucuauguaaaauuccaggauaguaaacccccucuaccaccugacgaguggguuuaa

SEQ ID NO: 261 - RNA, 660 nt, Artificial Sequence
  derived and/or modified CDS sequence (wt) from MERS-CoV__AFS88942__M
augucuaauaugacgcaacucacugaggcgcagauuauugccauuauuaaagacuggaacuuugcauggucccugaucuuucucuuaauuacuaucguacuacaguauggauacccaucccguaguaugacugucuaugucuuuaaaauguuuguuuuauggcuccuauggccaucuuccauggcgcuaucaauauuuagcgccguuuauccaauugaucuagcuucccagauaaucucuggcauuguagcagcuguuucagcuaugauguggauuuccuacuuugugcagaguauccggcuguuuaugagaacuggaucaugguggucauucaauccugagacuaauugccuuuugaacguuccauuuggugguacaacugucguacguccacucguagaggacucuaccaguguaacugcuguuguaaccaauggccaccucaaaauggcuggcaugcauuucggugcuugugacuacgacagacuuccuaaugaagucaccguggccaaacccaaugugcugauugcuuuaaaaauggugaagcggcaaagcuacggaacuaauuccggcguugccauuuaccauagauauaaggcagguaauuacaggaguccgccuauuacggcggauauugaacuugcauugcuucgagcuuag

SEQ ID NO: 262 - RNA, 660 nt, Artificial Sequence
  derived and/or modified CDS sequence (wt) from MERS-CoV__AGH58718__M
augucuaauaugacgcaacucacugaggcgcagauuauugccguuauuaaagacuggaacuuugcauggucccugaucuuucucuuaauuacuaucguacuacaguauggauacccaucccguaguaugacugucuaugucuuuaaaauguuuguuuuauggcuccuauggccaucuuccauggcgcuaucaauauuuagcaccguuuauccaauugaucuagcuucccagauaaucucuggcauuguagcagcuguuucagcuaugauguggauuuccuacuuugugcagaguauccggcuguuuaugagaacuggaucaugguggucauucaauccugagacuaauugccuuuugaacguuccauuuggugguacaacugucguacguccacucguagaggacucuaccaguguaacugcuguuguaaccaauggccaccucaaaauggcuggcaugcauuucggugcuugugacuacgacagacuuccuaaugaagucaccguggccaaacccaaugugcugauugcuuuaaaaauggugaagcggcaaagcuauggaacuaauuccggcguugccauuuaccauagauauaaggcagguaauuacaggaguccgccuauuacggcggauauugaacuugcauugcuucgagcuuag

SEQ ID NO: 263 - RNA, 660 nt, Artificial Sequence
  derived and/or modified CDS sequence (wt) from MERS-CoV__AGV08396__M
augucuaauaugacgcaacucacugaggcgcagauuauugccauuauuaaagacuggaacuuugcauggucccugaucuuucucuuaauuacuaucguacuacaguauggauacccaucccguaguaugacugucuaugucuuuaaaauguuuguuuuauggcuccuauggccaucuuccauggcgcuaucaauauuuagcgccauuuauccaauugaucuagcuucccagauaaucucuggcauuguagcagcuguuucagcuaugauguggauuuccuacuuugugcagaguauccggcuguuuaugagaacuggaucaugguggucauucaauccugagacuaauugccuuuugaacguuccauuuggugguacaacugucguacguccacucguagaggacuccaccaguguaacugcuguuguaaccaauggccaccucaaaauggcuggcaugcauuucggugcuugugacuacgacagacuuccuaaugaagucaccguggccaaacccaaugugcugauugcuuuaaaaauggugaagcggcaaagcuacggaacuaauuccggcguugccauuuaccauagauauaaggcagguaauuacaggaguccgccuauuacggcggauauugaacuugcauugcuucgagcuuag

SEQ ID NO: 264 - RNA, 660 nt, Artificial Sequence
  derived and/or modified CDS sequence (wt) from MERS-CoV__AGV08590__M
augucuaauaugacgcaacucacugaggcgcagauuauugccauuauuaaagacuggaacuuuguauggucccugaucuuucucuuaauuacuaucguacuacaguauggauacccaucccguaguaugacugucuaugucuuuaaaauguuuguuuuauggcuccuauggccaucuuccauggcgcuaucaauauuuagcgccguuuauccaauugaucuagcuucccagauaaucucuggcauuguagcagcuguuucagcuaugauguggauuuccuacuuugugcagaguauccggcuguuuaugagaacuggaucaugguggucauucaauccugagacuaauugccuuuugaacguuccauuuggugguacaacugucguacguccacucguagaggacucuaccaguguaacugcuguuguaaccaauggccaccucaaaauggcuggcaugcauuucggugcuugugacuacgacagacuuccuaaugaagucaccguggccaaacccaaugugcugauugcuuuaaaaauggugaagcggcaaagcuacggaacuaauuccggcguugccauuuaccauagauauaaggcagguaauuacaggaguccgccuauuacggcggauauugaacuugcauugcuucgagcuuag

SEQ ID NO: 265 - RNA, 660 nt, Artificial Sequence
  derived and/or modified CDS sequence (wt) from MERS-CoV__AHI48567__M
augucuaauaugacgcaacucgcugaggcgcagauuauugccauuauuaaagacuggaacuuugcauggucccugaucuuucucuuaauuacuaucguacuacaguauggauacccaucccguaguaugacugucuaugucuuuaaaauguuuguuuuauggcuccuauggccaucuuccauggcgcuaucaauauuuagcgccguuuauccaauugaucuagcuucccagauaaucucuggcauuguagcagcuguuucagcuaugauguggauuuccuacuuugugcagaguauccggcuguuuaugagaacuggaucaugguggucauucaauccugagacuaauugccuuuugaacguuccauuuggugguacaacugucguacguccacucguagaggacucuaccaguguaacugcuguuguaaccaauggccaccucaaaauggcuggcaugcauuucggugcuugugacuacgacagacuuccuaaugaagucaccguggccaaacccaaugugcugauugcuuuaaaaauggugaagcggcaaagcuacggaacuaauuccggcguugccauuuaccauagauauaaggcagguaauuacaggaguccgccuauuacggcggauauugaacuugcauugcuucgagcuuag

SEQ ID NO: 266 - RNA, 660 nt, Artificial Sequence
  derived and/or modified CDS sequence (wt) from MERS-CoV__AHI48589__M
augucuaauaugacgcaacucacugaggcgcagauuauugccguuauuaaagacuggaacuuugcauggucccugaucuuucucuuaauuacuaucguacuacaguauggauacccaucccguaguaugacugucuaugucuuuaaaauguuuguuuuauggcuccuauggccaucuuccauggcgcuaucaauauuuagcgccauuuauccaauugaucuagcuucccagauaaucucuggcauuguagcagcuguuucagcuaugauguggauuuccuacuuugugcagaguauccggcuguuuaugagaacuggaucaugguggucauucaauccugagacuaauugccuuuugaacguuccauuuggugguacaacugucguacguccacucguagaggacucuaccaguguaacugcuguuguaaccaauggccaccucaaaauggcuggcaugcauuucggugcuugugacuacgacagacuuccuaaugaagucaccguggccaaacccaaugugcugauugcuuuaaaaauggugaagcggcaaagcuacggaacuaauuccggcguugccauuuaccauagauauaaggcagguaauuacaggaguccgccuauuacggcggauauugaacuugcauugcuucgagcuuag

SEQ ID NO: 267 - RNA, 660 nt, Artificial Sequence
  derived and/or modified CDS sequence (wt) from MERS-CoV__AIL23940__M
augucuaauaugacgcaacucacugaggcgcagauuauugccauuauuaaagacuggaacuuugcauggucccugaucuuucucuuaauuacuaucguacuacaguauggauacccaucccguaguaugacugucuaugucuuuaaaauguuuguuuuauggcuccuauggccaucuuccauggcgcuaucaauauuuagcgccauuuauccaauugaucuagcuucccagauaaucucuggcauuguagcagcuguuucagcuaugauguggauuuccuacuuugugcagaguauccggcuguuuaugagaacuggaucaugguggucauucaauccugagacuaauugccuuuugaacguuccauuuggugguacaacugucguacguccacucguagaggacucuaccaguguaacugcuguuguaaccaauggccaccucaaaauggcuggcaugcauuucggugcuugugacuacgacagacuuccuaaugaagucaccguggccaaacccaauguggugauugcuuuaaaaauggugaagcggcaaagcuacggaacuaauuccggcguugccauuuaccauagauauaaggcagguaauuacaggaguccgccuauuacggcggauauugaacuugcauugcuucgagcuuag

SEQ ID NO: 268 - RNA, 660 nt, Artificial Sequence
  derived and/or modified CDS sequence (wt) from MERS-CoV__AKM76245__M
augucuaauauaacgcaacucacugaggcgcagauuauugccauuauuaaagacuggaacuuugcauggucccugaucuuucucuuaauuacuaucguacuacaguauggauacccaucccguaguaugacugucuaugucuuuaaaauguuuguuuuauggcuccuauggccaucuuccauggcgcuaucaauauuuagcgccguuuauccaauugaucuagcuucccagauaaucucuggcauuguagcagcuguuucagcuaugauguggauuuccuacuuugugcagaguauccggcuguuuaugagaacuggaucaugguggucauucaauccugagacuaauugccuuuugaacguuccauuuggugguacaacugucguacguccacucguagaggacucuaccaguguaacugcuguuguaaccaauggccaccucaaaauggcuggcaugcauuucggugcuugugacuacgacagacuuccuaaugaagucaccguggccaaacccaaugugcugauugcuuuaaaaauggugaagcggcaaagcuacggaacuaauuccggcguugccauuuaccauagauauaaggcagguaauuacaggaguccgccuauuacggcggauauugaacuugcauugcuucgagcuuag

SEQ ID NO: 269 - RNA, 660 nt, Artificial Sequence
  derived and/or modified CDS sequence (wt) from MERS-CoV__ALW82726__M
augucuaauaugacgcaacucacugaggcgcagauuauugccauuauuaaagacuggcacuuugcauggucccugaucuuucucuuaauuacuaucguacuacaguauggauacccaucccguaguaugacugucuaugucuuuaaaauguuuguuuuauggcuccuauggccaucuuccauggcgcuaucaauauuuagcgccauuuauccaauugaucuagcuucccagauaaucucuggcauuguagcagcuguuucagcuaugauguggauuuccuacuuugugcagaguauccggcuguuuaugagaacuggaucaugguggucauucaauccugagacuaauugccuuuugaacguuccaauuggugguacaacugucguacguccacucguagaggacucuaccaguguaacugcuguuguaaccaauggucaccucaaaauggcuggcaugcauuucggugcuugugacuacgacagacuuccuaaugaagucaccguggccaaacccaaugugcugauugcuuuaaaaauggugaagcggcaaagcuacggaacuaauuccggcguugccauuuaccauagauauaaggcagguaauuacaggaguccgccuauuacggcggauauugaacuugcauugcuucgagcuuag

SEQ ID NO: 270 - RNA, 660 nt, Artificial Sequence
  derived and/or modified CDS sequence (wt) from MERS-CoV__ALX27238__M
augucuaauaugacgcaacucacugaggcgcagauuauugccauuauuaaagacuggagcuuugcauggucccugaucuuucucuuaauuacuaucguacuacaguauggauacccaucccguaguaugacugucuaugucuuuaaaauguuuguuuuauggcuccuauggccaucuuccauggcgcuaucaauauuuagcgccguuuauccaauugaucuagcuucccagauaaucucuggcauuguagcagcuguuucagcuaugauguggauuuccuacuuugugcagaguauccggcuguuuaugagaacuggaucaugguggucauucaauccugagacuaauugccuuuugaacguuccauuuggugguacaacugucguacguccacucguagaggacucuaccaguguaacugcuguuguaaccaauggccaccucaaaauggcuggcaugcauuucggugcuugugacuacgacagacuuccuaaugaagucaccguggccaaacccaaugugcugauugcuuuaaaaauggugaagcggcaaagcuacggaacuaauuccggcguugccauuuaccauagauauaaggcagguaauuacaggaguccgccuauuacggcggauauugaacuugcauugcuucgagcuuag

SEQ ID NO: 271 - RNA, 660 nt, Artificial Sequence
  derived and/or modified CDS sequence (wt) from MERS-CoV__AMQ49021__M
augucuaauaugacgcaacucacugaggcgcagauuauugccauuauuaaagacuggcacuuugcauggucccugaucuuucucuuaauuacuaucguacuacaguauggauacccaucccguaguaugacugucuaugucuuuaaaauguuuguuuuauggcuccuauggccaucuuccauggcgcuaucaauauuuagcgccauuuauccaauugaucuagcuucccagauaaucucuggcauuguagcagcuguuucagcuaugauguggauuuccuacuuugugcagaguauccggcuguuuaugagaacuggaucaugguggucauucaauccugagacuaauugccuuuugaacguuccaauuggugguacaacugucguacguccacucguagaggacucuaccaguguaacugcuguuguaaccaauggucaccucaaaauggcuggcaugcauuucggugcuugugacuacgacagacuuucuaaugaagucaccguggccaaacccaaugugcugauugcuuuaaaaauggugaagcggcaaagcuacggaacuaauuccggcguugccauuuaccauagauauaaggcagguaauuacaggaguccgccuauuacggcggauauugaacuugcauugcuucgagcuuag

SEQ ID NO: 272 - RNA, 660 nt, Artificial Sequence
  derived and/or modified CDS sequence (wt) from MERS-CoV__AJG44108__M
augucuaauaugacgcaacucacugaggcgcagauuauugccauuauuaaagacuggaacuuugcauggucccugaucuuucucuuaauuacuaucguacuacaguauggauacccaucccguaguaugacugucuaugucuuuaaaauguuuguuuuauggcuccuauggccaucuuccauggcgcuaucaauauuuagcgccuuuuauccaauugaucuagcuucccagauaaucucuggcauuguagcagcuguuucagcuaugauguggauuuccuacuuugugcagaguauccggcuguuuaugagaacuggaucaugguggucauucaauccugagacuaauugccuuuugaacguuccauuuggugguacaacugucguacguccacucguagaggacucuaccaguguaacugcuguuguaaccaauggccaccucaaaauggcuggcaugcauuucggugcuugugacuacgacagacuuccuaaugaagucaccguggccaaacccaaugugcugauugcuuuaaaaauggugaagcggcaaagcuacggaacuaauuccggcguugccauuuaccauagauauaaggcagguaauuacaggaguccgccuauuacggcggauauugaacuugcauugcuucgagcuuag

SEQ ID NO: 273 - RNA, 660 nt, Artificial Sequence
  derived and/or modified CDS sequence (wt) from MERS-CoV__ALA49369__M
augucuaauaugacgcaacucacugaggcgcagauuauugccauuauuaaagacuggaacuuugcauggucccugaucuuucucuuaauuacuaucguacuacaguauggauacccaucccguaguaugacugucuaugucuuuaaaauguuuguuuuauggcuccuauggccaucuuccauggcgcuaucaauauuuagcgccauuuauccaauugaucuagcuucccagauaaucucuggcauuguagcagcuguuucagcuaugauguggauuuccuacuuugugcagaguauccggcuguuuaugagaacuggaucaugguggucauucaauccugagacuaauugccuuuugaacguuccaauuggugguacaacugucguacguccacucguagaggacucuaccaguguaacugcuguuguaaccaauggccaccucaaaauggcuggcaugcauuucggugcuugugacuacgacagacuuccuaaugaagucaccguggccaaacccaaugugcugauugcuuuaaaaauggugaagcggcaaagcuacggaacuaauuccggcguugccauuuaccauagauauaaggcagguaauuacaggaguccgccuauuacggcggauauugaacuugcauugcuucgagcuuag

SEQ ID NO: 274 - RNA, 660 nt, Artificial Sequence
  derived and/or modified CDS sequence (wt) from MERS-CoV__ALA49424__M
augucuaauaugacgcaacucacugaggcgcagauuauugccauuauuaaagacuggaacuuugcauggucccugaucuuucucuuaauuacuaucguacuacaguauggauacccaucccguaguaugacugucuaugucuuuaaaauguuuguuuuauggcuccuauggccaucuuccauggcgcuaucaauauuuagcgccauuuauccaauugaucuagcuucccagauaaucucuggcauuguagcagcuguuucagcuaugaugcggauuuccuacuuugugcagaguauccggcuguuuaugagaacuggaucaugguggucauucaaucccgagacuaauugccuuuugaacguuccauuuggugguacaacugucguacguccacucguagaggacucuaccaguguaacugcuguuguaaccaauggccaccucaaaauggcuggcaugcauuucggugcuugugacuacgacagacuuccuaaugaagucaccguggccaaacccaaugugcugauugcuuuaaaaauggugaagcggcaaagcuacggaacuaauuccggcguugccauuuaccauagauauaaggcagguaauuacaggaguccgccuauuacggcggauauugaacuugcauugcuucgagcuuag

SEQ ID NO: 275 - RNA, 660 nt, Artificial Sequence
  derived and/or modified CDS sequence (wt) from MERS-CoV__ALA49908__M
augucuaauaugacgcaacucacugaggcgcagauuauugccauuauuaaagacuggaacuuugcauggucccugaucuuucucuuaauuacuaucguacuacaguauggauacccaucccguaguaugacugucuaugucuuuaaaauguuuguuuuauggcuccuauggccaucuuccauggcgcuaucaauauuuagcgccauuuauccaauugaucuaucuucccagauaaucucuggcauuguagcagcuguuucagcuaugauguggauuuccuacuuugugcagaguauccggcuguuuaugagaacuggaucaugguggucauucaauccugagacuaauugccuuuugaacguuccauuuggugguacaacugucguacguccacucguagaggacucuaccaguguaacugcuguuguaaccaauggccaccucaaaauggcuggcaugcauuucggugcuugugacuacgacagacuuccuaaugaagucaccguggccaaacccaaugugcugauugcuuuaaaaauggugaagcggcaaagcuacggaacuaauuccggcguugccauuuaccauagauauaaggcagguaauuacaggaguccgccuauuacggcggauauugaacuugcauugcuucgagcuuag

SEQ ID NO: 276 - RNA, 660 nt, Artificial Sequence
  derived and/or modified CDS sequence (wt) from MERS-CoV__ALA49963__M
augucuaauaugacgcaacucacugaggcgcagauuauugccauuauuaaagacuggaacuuugcauggucccugaucuuucucuuaauuacuaucguacuacaguauggauacccaucccguaguaugacugucuaugucuuuaaaauguuuguuuuauggcuccuauggccaucuuccauggcgcuaucaauauuuagcgccauuuauccaauugaucuagcuucccagauaaucucuggcauuguagcagcuguuucagcuaugauguggauuuccuacuuugugcagaguauccggcuguuuaugagaacuggaucaugguggucauucaauccugagacuaauugccuuuugaacguuccaauuggugguacaacugucguacguccacucguagaggacucuaccaguguaacugcuguuguaaccaauggucaccucaaaauggcuggcaugcauuucggugcuugugacuacgacagacuuucuaaugaagucaccguggccaaacccaaugugcugauugcuuuaaaaauggugaagcggcaaagcuacggaacuaauuccggcguugccauuuaccauagauauaaggcagguaauuacaggaguccgccuauuacggcggauauugaacuugcauugcuucgagcuuag

SEQ ID NO: 277 - RNA, 1242 nt, Artificial Sequence
  derived and/or modified CDS sequence (wt) from MERS-CoV__AFS88943__N
auggcauccccugcugcaccucgugcuguuuccuuugccgauaacaaugauauaacaaauacaaaccuaucucgagguagaggacguaauccaaaaccacgagcugcaccaaauaacacugucucuugguacacugggcuuacccaacacgggaaagucccucuuaccuuuccaccugggcaggguguaccucuuaaugccaauucuaccccugcgcaaaaugcuggguauuggcggagacaggacagaaaaauuaauaccgggaauggaauuaagcaacuggcucccaggugguacuucuacuacacuggaacuggacccgaagcagcacucccauuccgggcuguuaaggauggcaucguuuggguccaugaagauggcgccacugaugcuccuucaacuuuugggacgcggaacccuaacaaugauucagcuauuguuacacaauucgcgcccgguacuaagcuuccuaaaaacuuccacauugaggggacuggaggcaauagucaaucaucuucaagagccucuagcuuaagcagaaacucuuccagaucuaguucacaagguucaagaucaggaaacucuacccgcggcacuucuccagguccaucuggaaucggagcaguaggaggugaucuacuuuaccuugaucuucugaacagacuacaagcccuugagucuggcaaaguaaagcaaucgcagccaaaaguaaucacuaagaaagaugcugcugcugcuaaaaauaagaugcgccacaagcgcacuuccaccaaaaguuucaacauggugcaagcuuuuggucuucgcggaccaggagaccuccagggaaacuuuggugaucuucaauugaauaaacucggcacugaggacccacguuggccccaaauugcugagcuugcuccuacagccagugcuuuuauggguaugucgcaauuuaaacuuacccaucagaacaaugaugaucauggcaacccuguguacuuccuucgguacaguggagccauuaaacuugacccaaagaaucccaacuacaauaagugguuggagcuucuugagcaaaauauugaugccuacaaaaccuucccuaagaaggaaaagaaacaaaaggcaccaaaagaagaaucaacagaccaaaugucugaaccuccaaaggagcagcgugugcaagguagcaucacucagcgcacucgcacccguccaaguguucagccugguccaaugauugauguuaacacugauuag

SEQ ID NO: 278 - RNA, 1236 nt, Artificial Sequence
  derived and/or modified CDS sequence (wt) from MERS-CoV__AFY13314__N
auggcauccccugcugcaccucgugcuguuuccuuugccgauaacaaugauauaacaaauacaaaccugucucgagguagaggacguaauccaaaaccacgagcugcaccaaauaacacugucucuugguacacugggcuuacccaacacgggaaagucccucuuaccuuuccaccugggcaggguguaccucuuaaugccaauuccaccccugcgcaaaaugcuggguauuggcggagacaggacagaaaaauuaauaccgggaauggaauuaagcaacuggcucccaggugguacuucuacuacacuggaacuggacccgaagcagcacucccauuccgggcuguuaaggauggcaucguuuggguccaugaagauggcgccacugaugcuccuucaacuuuugggacgcggaacccuaacaaugauucagcuauuguuacacaauucgcgcccgguacuaagcuuccuaaaaacuuccacauugaggggacuggaggcaauagucaaucaucuucaagagccucuagcguaagcagaaacucuuccagaucuaguucacaagguucaagaucaggaaacucuacccgcggcacuucuccagguccaucuggaaucggagcaguaggaggugaucuacuuuaccuugaucuucugaacagacuacaagcccuugagucuggcaaaguaaagcaaucgcagccaaaaguaaucacuaagaaagaugcugcugcugcuaaaaauaagaugcgccacaagcgcacuuccaccaaaaguuucaacauggugcaagcuuuuggucuucgcggaccaggagaccuccagggaaacuuuggugaucuucaauugaauaaacucggcacugaggacccacguuggccccaaauugcugagcuugcuccuacagccagugcuuuuauggguaugucgcaauuuaaacuuacccaucagaacaaugaugaucauggcaacccuguguacuuccuucgguacaguggagccauuaaacuugacccaaagaaucccaacuacaauaagugguuggagcuucuugagcaaaauauugaugccuacaaaaccuucccuaagaaggaaaagaaacaaaaggcaccaaaagaagaaucaacagaccaaaugucugaaccuccuaaggagcaucgugugcaagguacucagcgcacucgcacccguccaaguguucagccugguccaaugauugauguuaacacugauuag

SEQ ID NO: 279 - RNA, 1242 nt, Artificial Sequence
  derived and/or modified CDS sequence (wt) from MERS-CoV__AGH58724__N
auggcauccccugcugcaccucgugcuguuuccuuugccuauaacaaugauauaacaaauacaaaccugucucgagguagaggacguaauccaaaaccacgagcugcaccaaauaacacugucucuugguacacugggcuuacccaacacgggaaagucccucuuaccuuuccaccugggcaggguguaccucuuaaugccaauucuaccccugcgcaaaaugcuggguauuggcggagacaggacagaaaaauuaauaccgggaauggaauuaagcaacuggcucccaggugguacuucuacuacacuggaacuggacccgaagcagcacucccauuccgggcuguuaaggauggcaucguuuggguccaugaagauggcgccacugaugcuccuucaacuuuugggacgcggaacccuaacaaugauucagcuauuguuacacaauucgcgcccgguacuaagcuuccuaaaaacuuccacauugaggggacuggaggcaauagucaaucaucuucaagagccucuagcguaagcagaaacucuuccagaucuaguucacaagguucaagaucaggaaacucuacccgcggcacuucuccagguccaucuggaaucggagcaguaggaggugaucuacuuuaccuugaucuucugaacagacuacaagcccuugagucuggcaaaguaaagcaaucgcagccaaaaguaaucacuaagaaagaugcugcugcugcuaaaaauaagaugcgccacaagcgcacuuccaccaaaaguuucaacauggugcaagcuuuuggucuucgcggaccaggagaccuccagggaaacuuuggugaucuucaauugaauaaacucggcacugaggacccacguuggccccaaauugcugagcuugcuccuacagccagugcuuuuauggguaugucgcaauuuaaacuuacccaucagaacaaugaugaucauggcaacccuguguacuuccuucgguacaguggagccauuaaacuugacccaaagaaucccaacuacaauaagugguuggagcuucuugagcaaaauauugaugccuacaaaaccuucccuaagaaggaaaagaaacaaaaggcaccaaaagaagaaucaacagaccaaaugucugaaccuccaaaggagcagcgugugcaagguagcaucacucagcgcacucgcacccguccaaguguucagccugguccaaugauugauguuaacacugauuag

SEQ ID NO: 280 - RNA, 1242 nt, Artificial Sequence
  derived and/or modified CDS sequence (wt) from MERS-CoV__AGV08397__N
auggcauccccugcugcaccucgugcuguuuccuuugccgauaacaaugauauaacaaauacaaaccugucucgagguagaggacguaauccaaaaccacgagcugcaccaaauaacacugucucuugguacacugggcuuacccaacacgggaaagucccucuuaccuuuccaccugggcaggguguaccucuuaaugccaauuccaccccugcgcaaaaugcuggguauuggcggagacaggacagaaaaauuaauaccgggaauggaauuaagcaacuggcucccaggugguacuucuacuacacuggaacuggacccgaagcagcacucccauuccgggcuguuaaggauggcaucguuuggguccaugaagauggcgccacugaugcuccuucaacuuuugggacgcggaacccuaacaaugauucagcuauuguuacacaauucgcgcccgguacuaagcuuccuaaaaacuuccacauugaggggacuggaggcaauagucaaucaucuucaagagccucuagcguaagcagaaacucuuccagaucuaguucacaagguucaagaucaggaaauucuacccgcggcacuucuccagguccaucuggaaucggagcaguaggaggugaucuacuuuaccuugaucuucugaacagacuacaagcccuugagucuggcaaaguaaagcaaucgcagccaaaaguaaucacuaagaaagaugcugcugcugcuaaaaauaagaugcgccacaagcgcacuuccaccaaaaguuucaacauggugcaagcuuuuggucuucgcggaccaggagaccuccagggaaacuuuggugaucuucaauugaauaaacucggcacugaggacccacguuggccccaaauugcugagcuugcuccuacagccagugcuuuuauggguaugucgcaauuuaaacuuacccaucagaacaaugaugaucauggcaacccuguguacuuccuucgguacaguggagccauuaaacuugacccaaagaaucccaacuacaauaagugguuggagcuucuugagcaaaauauugaugccuacaaaaccuucccuaagaaggaaaagaaacaaaaggcaccaaaagaagaauuaacagaccaaaugucugaaccuccuaaggagcagcgugugcaagguagcaucacucagcgcacucgcacccguccaaguguucagccugguccaaugauugauguuaacacugauuag

SEQ ID NO: 281 - RNA, 1242 nt, Artificial Sequence
  derived and/or modified CDS sequence (wt) from MERS-CoV__AGV08415__N
auggcauccccugcugcaccucgugcuguuuccuuugccgauaacaaugauauaacaaauacaaaccugucucgagguagaggacguaauccaaaaccacgagcugcaccaaauaacacugucucuugguacacugggcuuacccaacacgggaaagucccucuuaccuuuccaccugggcaggguguaccucuuaaugccaauuccaccccugcgcaaaaugcuggguauuggcggagacaggacagaaaaauuaauaccgggaauggaauuaagcaacuggcucccaggugguacuucuacuacacuggaacuggacccgaagcagcacucccauuccgggcuguuaaggauggcaucguuuggguccaugaagauggcgccacugaugcuccuucaacuuuugggacgcggaacccuaacaaugauucagcuauuguuacacaauucgcgcccgguacuaagcuuccuaaaaacuuccacauugaggggacuggaggcaauagucaaucaucuucaagagccucuagcguaagcagaaacucuuccagaucuaguucacaagguucaagaucaggaaacucuacccgcggcacuucuccagguccaucuggaaucggagcaguaggaggugaucuacuuuaccuugaucuucugaacagacuacaagcccuugagucuggcaaaguaaagcaaucgcagccaaaaguaaucacuaagaaagaugcugcugcugcuaaaaauaagaugcgccacaagcgcacuuccaccaaaaguuucaacauggugcaagcuuuuggucuucgcggaccaggagaccuccagggaaacuuuggugaucuucaauugaauaaacucggcacugaggacccacguuggccccaaauugcugagcuugcuccuacagccagugcuuuuauggguaugucgcaauuuaaacuuacccaucagaacaaugaugaucauggcaacccuguguacuuccuucgguacaguggagccauuaaacuugacccaaagaaucccaacuacaauaagugguuggagcuucuugagcaaaauauugaugccuacaaaaccuucccuaagaaggaaaagaaacaaaaggcaccaaaagaagaaucaacagaccaaaugucugaaccuccaaaggagcagcgugugcaagguagcaucacucagcgcacucgcacccguccaaguguucagccugguccaaugauugauguuaacacugauuag

SEQ ID NO: 282 - RNA, 1242 nt, Artificial Sequence
  derived and/or modified CDS sequence (wt) from MERS-CoV__AGV08487__N
auggcauccccugcugcaccucgugcuguuuccuuugccgauaacaaugauauaacaaauacaaaccugucucgagguagaggacguaauccaaaaccacgagcugcaccaaauaacacugucucuugguacacugggcuuacccaacacgggaaagucccucuuaccuuuccaccugggcaggguguaccucuuaaugccaauuccaccccugcgcaaaaugcuggguauuggcggagacaggacagaaaaauuaauaccgggaauggaauuaagcaacuggcucccaggugguacuucuacuacacuggaacuggacccgaagcagcacucccauuccgggcuguuaaggauggcaucguuuggguccaugaacauggcgccacugaugcuccuucaacuuuugggacgcggaacccuaacaaugauucagcuauuguuacacaauucgcgcccgguacuaagcuuccuaaaaacuuccacauugaggggacuggaggcaauagucaaucaucuucaagagccucuagcguaagcagaaacucuuccagaucuaguucacaagguucaagaucaggaaacucuacccgcggcacuucuccagguccaucuggaaucggagcaguaggaggugaucuacuuuaccuugaucuucugaacagacuacaagcccuugagucuggcaaaguaaagcaaucgcagccaaaaguaaucacuaagaaagaugcugcugcugcuaaaaauaagaugcgccacaagcgcacuuccaccaaaaguuucaacauggugcaagcuuuuggucuucgcggaccaggagaccuccagggaaacuuuggugaucuucaauugaauaaacucggcacugaggacccacguuggccccaaauugcugagcuugcuccuacagccagugcuuuuauggguaugucgcaauuuaaacuuacccaucagaacaaugaugaucauggcaacccuguguacuuccuucgguacaguggagccauuaaacuugacccaaagaaucccaacuacaauaagugguuggagcuucuugagcaaaauauugaugccuacaaaaccuucccuaagaaggaaaagaaacaaaaggcaccaaaagaagaaucaacagaccaaaugucugaaccuccaaaggagcagcgugugcaagguagcaucacucagcgcacucgcacccguccaaguguucagccugguccaaugauugauguuaacacugauuag

SEQ ID NO: 283 - RNA, 1242 nt, Artificial Sequence
  derived and/or modified CDS sequence (wt) from MERS-CoV__AHC74095__N
auggcauccccugcugcaccucgugcuguuuccuuugccgauaacaaugauauaacaaauacaaaccugucucgagguagaggacguaauccaaaaccacgagcugcaccaaauaacacugucucuugguacacugggcuuacccaacacgggaaagucccucuuaccuuuccaccugggcaggguguaccucuuaaugccaauuccaccccugcgcaaaaugcuggguauuggcggagacaggacagaaaaauuaauaccgggaauggaauuaagcaacuggcucccaggugguacuucuacuacacuggaacuggacccgaagcagcacucccauuccgggcuguuaaggauggcaucguuuggguccaugaagauggcgccacugaugcuccuucaacuuuugggacgcggaacccuaacaaugauuuagcuauuguuacacaauucgcgcccgguacuaagcuuccuaaaaacuuccacauugaggggacuggaggcaauagucaaucaucuucaagagccucuagcguaagcagaaacucuuccagaucuaguucacaagguucaagaucaggaaacucuacccgcggcacuucuccagguccaucuggaaucggagcaguaggaggugaucuacuuuaccuugaucuucugaacagacuacaagcucuugagucuggcaaaguaaagcaaucgcagccaaaaguaaucacuaagaaagaugcugcugcugcuaaaaauaagaugcgccacaagcgcacuuccaccaaaaguuucaacauggugcaagcuuuuggucuucgcggaccaggagaccuccagggaaacuuuggugaucuucaauugaauaaacucggcacugaggacccacguuggccccaaauugcugagcuugcuccuacagccagugcuuuuauggguaugucgcaauuuaaacuuacccaucagaacaaugaugaucauggcaacccuguguacuuccuucgguacaguggagccauuaaacuugacccaaagaaucccaacuacaauaagugguuggagcuucuugagcaaaauauugaugccuacaaaaccuucccuaagaaggaaaagaaacaaaaggcaccaaaagaagaaucaacagaccaaaugucugaaccuccaaaggagcagcgugugcaagguagcaucacucagcgcacucgcacccguccaaguguucagccugguccaaugauugauguuaacacugauuag

SEQ ID NO: 284 - RNA, 1242 nt, Artificial Sequence
  derived and/or modified CDS sequence (wt) from MERS-CoV__AHI48535__N
auggcauccccugcugcaccucgugcuguuuccuuugccgauaacaaugauauaacaaauacaaaccugucucgagguagaggacguaauccaaaaccacgagcugcaccaaauaacacugucucuugguacacugggcuuacccaacacgggaaagucccucuuaccuuuucaccugggcaggguguaccucuuaaugccaauuccaccccugcgcaaaaugcuggguauuggcggagacaggacagaaaaauuaauaccgggaauggaauuaagcaacuggcucccaggugguacuucuacuacacuggaacuggacccgaagcagcacucccauuccgggcuguuaaggauggcaucguuuggguccaugaagauggcgccacugaugcuccuucaacuuuugggacgcggaacccuaacaaugauucagcuauuguuacacaauucgcgcccgguacuaagcuuccuaaaaacuuccacauugaggggacuggaggcaauagucaaucaucuucaagagccucuagcguaagcagaaacucuuccagaucuaguucacaagguucaagaucaggaaacucuacccgcggcacuucuccagguccaucuggaaucggagcaguaggaggugaucuacuuuaccuugaucuucugaacagacuacaagcccuugagucuggcaaaguaaagcaaucgcagccaaaaguaaucacuaagaaagaugcugcugcugcuaaaaauaagaugcgccacaagcgcacuuccaccaaaaguuucaacauggugcaagcuuuuggucuucgcggaccaggagaccuccagggaaacuuuggugaucuucaauugaauaaacucggcacugaggacccacguuggccccaaauugcugagcuugcuccuacagccagugcuuuuauggguaugucgcaauuuaaacuuacccaucagaacaaugaugaucauggcaacccuguguacuuccuucgguacaguggagccauuaaacuugacccaaagaaucccaacuacaauaagugguuggagcuucuugagcaaaauauugaugccuacaaaaccuucccuaagaaggaaaagaaacaaaaggcaccaaaagaagaaucaacagaccaagugucugaaccuccaaaggagcagcgugugcaagguaucaucacucagcgcacucgcacccguccaaguguucagccugguccaaugauugauguuaacacugauuag

SEQ ID NO: 285 - RNA, 1242 nt, Artificial Sequence
  derived and/or modified CDS sequence (wt) from MERS-CoV__AIL23941__N
auggcaucccuugcugcaccucgugcuguuuccuuugccgauaacaaugauauaacaaauacaaaccugucucgagguagaggacguaauccaaaaccacgagcugcaccaaauaacacugucucuugguacacugggcuuacccaacacgggaaagucccucuuaccuuuccaccugggcaggguguaccucuuaaugccaauuccaccccagcgcaaaaugcuggguauuggcggagacaggacagaaaaauuaauaccgggaauggaauuaagcaacuggcucccaggugguacuucuacuacacuggaaccggacccgaagcagcacucccauuccgggcuguuaaggauggcaucguuuggguccaugaacauggcgccacugaugcuccuucaacuuuugggacgcggaacccuaacaaugauucagcuauuguuacacaauucgcgcccgguacuaagcuuccuaaaaacuuccacauugaggggacuggaggcaauagucaaucaucuucaagagccucuagcguaagcagaaacucuuccagaucuaguucacaagguucaagaucaggaaacucuacccgcggcacuucuccagguccaucuggaaucggagcaguaggaggugaucuacuuuaccuugaucuucugaacagacuacaagcccuugagucuggcaaaguaaagcaaucgcagccaaaaguaaucacuaagaaagaugcugcugcugcuaaaaauaagaugcgccacaagcgcacuuccaccaaaaguuucaacauggugcaagcuuuuggucuucgcggaccaggagaccuccagggaaacuuuggugaucuucaauugaauaaacucggcacugaggacccacguuggccccaaauugcugagcuugcuccuacagccagugcuuuuauggguaugucgcaauuuaaacuuacccaucagaacaaugaugaucauggcaacccuguguacuuccuucgguacaguggagccauuaaacuugacccaaagaaucccaacuacaauaagugguuggagcuucuugagcaaaauauugaugccuacaaaaccuucccuaagaaggaaaagaaacaaaaggcaccaaaagaagaaucaacagaccaaaugucugaaccuccuaaggagcagcgugugcaagguagcaucacucagcgcacucgcacccguccaaguguucagccugguccaaugauugauguuaacacugauuag

SEQ ID NO: 286 - RNA, 1242 nt, Artificial Sequence
  derived and/or modified CDS sequence (wt) from MERS-CoV__AIL23996__N
auggcauccccugcugcaccucgugcuguuuccuuugccgauaacaaugauauaacaaauacaaaccugucucgagguagaggacguaauccaaaaccacgagcugcaccaaauaacacugucucuugguacacugggcuuacccaacacgggaaagucccucuuaccuuuccaccugggcaggguguaccucuuaaugccaauuccaccccugcgcaaaaugcuggguauuggcggagacaggacagaaaaauuaauaccgggaauggaauuaagcaacuggcucccaggugguacuucuacuacacuggaacuggacccgaagcagcacucccauuccgggcuguuaaggauggcaucguuuggguccaugaagauggcgccacugaugcuccuucaacuuuugggacgcggaacccuaacaaugauuuagcuauuguuacacaauucgcgcccgguacuaagcuuccuaaaaacuuccacauugaggggacuggaggcaauagucaaucaucuucaagagccucuagcguaagcagaaacucuuccagaucuaguucacaagguucaagaucaggaaacucuacccgcggcacuucuccagguccaucuggaaucggagcaguaggaggugaucuacuuuaccuugaucuucugaacagacuacaagcccuugagucuggcaaaguaaagcaaucgcagccaaaaguaaucacuaagaaagaugcugcugcugcuaaaaauaagaugcgccacaagcgcacuuccaccaaaaguuucaacauggugcaagcuuuuggucuucgcggaccaggagaccuccagggaaacuuuggugaucuucaauugaauaaacucggcacugaggacccacguuggccccaaauugcugagcuugcuccuacagccagugcuuuuauggguaugucgcaauuuaaacuuacccaucagaacaaugaugaucauggcaacccuguguacuuccuucgguacaguggagccauuaaacuugacccaaagaaucccaacuacaauaagugguuggagcuucuugagcaaaauauugaugccuacaaaaccuucccuaagaaggaaaagaaacaaaaggcaccaaaagaagaaucaacagaccaaaugucugaaccuccuaaggagcagcgugugcaagguagcaucacucagcacacucgcacccguccaaguguucagccugguccaaugauugauguuaacacugauuag

SEQ ID NO: 287 - RNA, 1242 nt, Artificial Sequence
  derived and/or modified CDS sequence (wt) from MERS-CoV__AIY60565__N
auggcagccccugcugcaccucgugcuguuuccuuugccgauaacaaugauauaacaaauacaaaccugucucgagguagaggacguaauccaaaaccacgagcugcaccaaauaacacugucucuugguacacugggcuuacccaacacgggaaagucccucuuaccuuuccaccugggcaggguguaccucuuaaugccaauuccaccccugcgcaaaaugcuggguauuggcggagacaggacagaaaaauuaauaccgggaauggaauuaagcaacuggcucccaggugguacuucuacuacacuggaacuggacccgaagcagcacucccauuccgggcuguuaaggauggcaucguuuggguccaugaagauggcgccacugaugcuccuucaacuuuugggacgcggaacccuaacaaugauucagcuauuguuacacaauucgcgcccgguacuaagcuuccuaaaaacuuccacauugaggggacuggaggcaauagucaaucaucuucaagagccucuagcguaagcagaaacucuuccagaucuaguucacaagguucaagaucaggaaacucuacccgcggcacuucuccaguuccaucuggaaucggagcaguaggaggugaucuacuuuaccuugaucuucugaacagacuacaagcccuugagucuggcaaaguaaagcaaucgcagccaaaaguaaucacuaagaaagaugcugcugcugcuaaaaauaagaugcgccacaagcgcacuuccaccaaaaguuucaacauggugcaagcuuuuggucuucgcggaccaggagaccuccagggaaacuuuggugaucuucaauugaauaaacucggcacugaggacccacguuggccccaaauugcugagcuugcuccuacagccagugcuuuuauggguaugucgcaauuuaaacuuacccaucagaacaaugaugaucauggcaacccuguguacuuccuucgguacaguggagccauuaaacuugacccaaagaaucccaacuacaauaagugguuggagcuucuugagcaaaauauugaugccuacaaaaccuucccuaagaaggaaaagaaacaaaaggcaccaaaagaagaaucaacagaccaaaugucugaaccuccaaaggagcagcgugugcaagguagcaucacucagcgcacucgcacccguccaaguguucagccugguccaaugauugauguuaacacugauuag

SEQ ID NO: 288 - RNA, 1242 nt, Artificial Sequence
  derived and/or modified CDS sequence (wt) from MERS-CoV__AIZ74424__N
auggcagccccugcugcaccucgugcuguuuccuuugccgauaacaaugauauaacaaauacaaaccugucucgagguagaggacguaauccaaaaccacgagcugcaccaaauaacacugucucuugguacacugggcuuacccaacacgggaaagucccucuuaccuuuccaccugggcaggguguaccucuuaaugccaauuccaccccugcgcaaaaugcuggguauuggcggagacaggacagaaaaauuaauaccgggaauggaauuaagcaacuggcucccaggugguacuucuacuacacuggaacuggacccgaagcagcacucccauuccgggcuguuaaggauggcaucguuuggguccaugaagauggcgccacugaugcuccuucaacuuuugggacgcggaacccuaacaaugauucagcuauuguuacacaauucgcgcccgguacuaagcuuccuaaaaacuuccacauugaggggacuggaggcaauagucaaucaucuucaagagccucuagcguaagcagaaacucuuccagaucuaguucacaagguucaagaucaggaaacucuacccgcggcacuucuccagguccaucuggaaucggagcaguaggaggugaucuacuuuaccuugaucuucugaacagacuacaagcccuugagucuggcaaaguaaagcaaucgcagccaaaaguaaucacuaagaaagaugcugcugcugcuaaaaauaagaugcgccacaagcgcacuuccaccaaaaguuucaacauggugcaagcuuuuggucuucgcggaccaggagaccuccagggaaacuuuggugaucuucaauugaauaaacucggcacugaggacccacguuggccccaaauugcugagcuugcuccuacagccagugcuuuuauggguaugucgcaauuuaaacuuacccaucagaacaaugaugaucauggcaacccuguguacuuccuucgguacaguggagccauuaaacuugacccaaagaaucccaacuacaauaagugguuggagcuucuugagcaaaauauugaugccuacaaaaccuucccuaagaaggaaaagaaacaaaaggcaccaaaagaagaaucaacagaccaaaugucugaaccuccaaaggagcagcgugugcaagguagcaucacucagcgcacucgcacccguccaaguguucagccugguccaaugauugauguuaacacugauuag

SEQ ID NO: 289 - RNA, 1242 nt, Artificial Sequence; identical to SEQ ID NO: 288
  derived and/or modified CDS sequence (wt) from MERS-CoV__AIZ74430__N

SEQ ID NO: 290 - RNA, 1242 nt, Artificial Sequence
  derived and/or modified CDS sequence (wt) from MERS-CoV__AKI29291__N
auggcauccccugcugcaccucgugcuguuuccuuugccgauaacaaugauauaacaaauacaaaccugucucgagguagaggacguaauccaaaaccacgagcugcaccaaauaacacugucucuugguacacugggcuuacccaacacgggaaagucccucuuaccuuuccaccugggcaggguguaccucuuaaugccaauuccaccccugcgcaaaaugcuggguauuggcggagacaggacagaaaaauuaauaccgggaauggaauuaagcaacuggcucccaggugguacuucuacuacacuggaacuggacccgaagcagcacucccauuccgggcuguuaaggauggcaucguuuggguccaugaagauggcgccacugaugcuccuucaacuuuugggacgcggaacccuaacaaugauucagcuauuguuacacaauucgcgcccgguacuaagcuuccuaaaaacuuccacauugaggggacuggaggcaauagucaaucaucuucaagagccucuagcguaagcagaaacucuuccagaucuaguucacaagguucaagaucaggaaacucuacccgcggcacuucuccagguccaucuggaaucggagcaguaggaggugaucuacuuuaccuugaucuucugaacagacuacaagcccuugagucuggcaaaguaaagcaaucgcagccaaaaguaaucacuaagaaggaugcugcugcugcuaaaaauaagaugcgccacaagcgcacuuccaccaaaaguuucaacauggugcaagcuuuuggucuucgcggaccaggagaccuccagggaaacuuuggugaucuucaauugaauaaacucggcacugaggacccacguuggccccaaauugcugagcuugcuccuacagccagugcuuuuauggguaugucgcaauuuaaacuuacccaucagaacaaugaugaucauggcaacccuguguacuuccuucgguacaguggagccauuaaacuugacccaaagaaucccaacuacaauaagugguuggagcuucuugagcaaaauauugaugccuacaaaaccuucccuaagaaggaaaagaaacaaaaggcaccaaaagaagaaucaacagaccaaaugucugaaccuccaaaggagcagcgugugcaagguagcaucacucagcgcauucgcacccguccaaguguucagccugguccaaugauugauguuaacacugauuag

SEQ ID NO: 291 - RNA, 1242 nt, Artificial Sequence
  derived and/or modified CDS sequence (wt) from MERS-CoV__AKK52599__N
auggcauccccugcugcaccuugugcuguuuccuuugccgauaacaaugauauaacaaauacaaaccugucucgagguagaggacguaauccaaaaccacgagcugcaccaaauaacacugucucuugguacacugggcuuacccaacacgggaaagucccucuuaccuuuccaccugggcaggguguaccucuuaaugccaauuccaccccugcgcaaaaugcuggguauuggcggagacaggacagaaaaauuaauaccgggaauggaauuaagcaacuggcucccaggugguacuucuacuacacuggaacuggacccgaagcagcacucccauuccgggcuguuaaggauggcaucguuuggguccaugaagauggcgccacugaugcuccuucaacuuuugggacgcggaacccuaacaaugauucagcuauuguuacacaauucgcgcccgguacuaagcuuccuaaaaacuuccacauugaggggacuggaggcaauagucaaucaucuucaagagccucuagcguaagcagaaacucuuccagaucuaguucacaagguucaagaucaggaaacucuacccgcggcacuucuccagguccaucuggaaucggagcaguaggaggugaucuacuuuaccuugaucuucugaacagacuacaagcccuugagucuggcaaaguaaagcaaucgcagccaaaaguaaucacuaagaaagaugcugcugcugcuaaaaauaagaugcgccacaagcgcacuuccaccaaaaguuucaacauggugcaagcuuuuggucuucgcggaccaggagaccuccagggaaacuuuggugaucuucaauugaauaaacucggcacugaggacccacguuggccccaaauugcugagcuugcuccuacagccagugcuuuuauggguaugucgcaauuuaaacuuacccaucagaacaaugaugaucauggcaacccuguguacuuccuucgguacaguggagccauuaaacuugacccaaagaaucccaacuacaauaagugguuggagcuucuugagcaaaauauugaugccuacaaaaccuucccuaagaaggaaaagaaacaaaaggcaccaaaagaagaaucaacagaccaaaugucugaaccuccaaaggagcagcgugugcaagguagcaucacucagcgcacucgcacccguccaaguguucagccugguccaaugauugauguuaacacugauuag

SEQ ID NO: 292 - RNA, 1242 nt, Artificial Sequence
  derived and/or modified CDS sequence (wt) from MERS-CoV__AKN24774__N
auggcauccccugcugcaccucgugcuguuuccuuugccgauaacaaugauauaacaaauacaaaccugucucgagguagaggacguaauccaaaaccacgagcugcaccaaauaacacugucucuugguacacugggcuuacccaacacgggaaagucccucuuaccuuuccaccugggcaggguguaccucuuaaugccaauuccaccccugcgcaaaaugcuggguauuggcggagacaggacagaaaaauuaauaccgggaauggaauuaagcaacuggcucccaggugguacuucuacuacacuggaacuggacccgaagcagcacucccauuccgggcuguuaaggauggcaucguuuggguccaugaagauggcgccacugaugcuccuucaacuuuugggacgcggaacccuaacaaugauuuagcuauuguuacacaauucgcgcccgguacuaagcuuccuaaaaacuuccacauugaggggacuggaggcaauagucaaucaucuucaagagccucuagcguaagcagaaacucuuccagaucuaguucacaagguucaagaucaggaaacucuacccgcggcacuucuccagguccaucuggaaucggagcaguaggaggugaucuacuuuaccuugaucuucugaacagacuacaagcccuugagucuggcaaaguaaagcaaucgcagccaaaaguaaucacuaagaaagaugcugcugcugcuaaaaauaagaugcgccacaagcgcacuuccaccaaaaguuucaacauggugcaagcuuuuggucuucgcggaccaggagaccuccagggaaacuuuggugaucuucaauugaauaaacucggcacugaggacccacguuggccccaaauugcugagcuuguuccuacagccagugcuuuuauggguaugucgcaauuuaaacuuacccaucagaacaaugaugaucauggcaacccuguguacuuccuucgguacaguggagccauuaaacuugacccaaagaaucccaacuacaauaagugguuggagcuucuugagcaaaauauugaugccuacaaaaccuucccuaagaaggaaaagaaacaaaaggcaccaaaagaagaaucaacagaccaaaugucugaaccuccuaaggagcagcgugugcaagguagcaucacucagcacacucgcacccguccaaguguucagccugguccaaugauugauguuaacacugauuag

SEQ ID NO: 293 - RNA, 1242 nt, Artificial Sequence
  derived and/or modified CDS sequence (wt) from MERS-CoV__ALW82676__N
auggcauccccugcugcaccucgugcuguuuccuuugccgauaacaaugauacaacaaauacaaaccugucucgagguagaggacguaauccaaaaccacgagcugcaccaaauaacacugucucuugguacacugggcuuacccaacacgggaaagucccucuuaccuuuccaccugggcaggguguaccucuuaaugccaauuccaccccugcgcaaaaugcuggguauuggcggagacaggacagaaaaauuaauaccgggaauggaauuaagcaacuggcucccaggugguacuucuacuacacuggaacuggacccgaagcagcacucccauuccgggcuguuaaggauggcaucguuuggguccaugaagauggcgccacugaugcuccuucaacuuuugggacgcggaacccuaacaaugauucagcuauuguuacacaauucgcgcccgguacuaagcuuccuaaaaacuuccacauugaggggacuggaggcaauagucaaucaucuucaagagccucuagcguaagcagaaacucuuccagaucuaguucacaagguucaagaucaggaaacucuacccgcggcacuucuccagguccaucuggaaucggagcaguaggaggugaucuacuuuaccuugaucuucugaacagacuacaagcccuugagucuggcaaaguaaagcaaucgcagccaaaaguaaucacuaagaaagaugcugcugcugcuaaaaauaagaugcgccacaagcgcacuuccaccaaaaguuucaacauggugcaagcuuuuggucuucgcggaccaggagaccuccagggaaacuuuggugaucuucaauugaauaaacucggcacugaggacccacguuggccccaaauugcugagcuugcuccuacagccagugcuuuuauggguaugucgcaauuuaaacuuacccaucagaacaaugaugaucauggcaacccuguguacuuccuucgguacaguggagccauuaaacuugacccaaagaaucccaacuacaauaagugguuggagcuucuugagcaaaauauugaugccuacaaaaccuucccuaagaaggaaaagaaacaaaaggcaccaaaagaagaaucaacagaccaaaugucugaaccuccaaaggagcagcgugugcaagguagcaucacucagcgcacucgcacccguccaaguguucagccugguccaaugauugauguuaacacugauuag

SEQ ID NO: 294 - RNA, 1242 nt, Artificial Sequence
  derived and/or modified CDS sequence (wt) from MERS-CoV__AMQ49033__N
auggcauccccugcugcaccucgugcuguuuucuuugccgauaacaaugauauaacaaauacaaaccugucucgagguagaggacguaauccaaaaccacgagcugcaccaaauaacacugucucuugguacacugggcuuacccaacacgggaaagucccucuuaccuuuccaccugggcaggguguaccucuuaaugccaauuccaccccugcgcaaaaugcuggguauuggcggagacaggacagaaaaauuaauaccgggaauggaauuaagcaacuggcucccaggugguacuucuacuacacuggaacuggacccgaagcagcacucccauuccgggcuguuaaggauggcaucguuuggguccaugaagauggcgccacugaugcuccuucaacuuuugggacgcggaacccuaacaaugauucagcuauuguuacacaauucgcgcccgguacuaagcuuccuaaaaacuuccacauugaggggacuggaggcaauagucaaucaucuucaagagccucuagcguaagcagaaacucuuccagaucuaguucacaagguucaagaucaggaaacucuacccgcggcacuucuccagguccaucuggaaucggagcaguaggaggugaucuacuuuaccuugaucuucugaacagacuacaagcccuugagucuggcaaaguaaagcaaucgcagccaaaaguaaucacuaagaaagaugcugcugcugcuaaaaauaagaugcgccacaagcgcacuuccaccaaaaguuucaacauggugcaagcuuuuggucuucgcggaccaggagaccuccagggaaacuuuggugaucuucaauuuaauaaacucggcacugaggacccacguuggccccaaauugcugagcuugcuccuacagccagugcuuuuauggguaugucgcaauuuaaacuuacccaucagaacaaugaugaucauggcaacccuguguacuuccuucgguacaguggagccauuaaacuugacccaaagaaucccaacuacaauaagugguuggagcuucuugagcaaaauauugaugccuacaaaaccuucccuaagaaggaaaagaaacaaaaggcaccaaaagaagaaucaacagaccaaaugucugaaccuccaaaggagcagcgugugcaagguagcaucacucagcgcacucgcacccguccaaguguucagccugguccaaugauugauguuaacacugauuag

SEQ ID NO: 295 - RNA, 1242 nt, Artificial Sequence
  derived and/or modified CDS sequence (wt) from MERS-CoV__AHL18098__N
auggcauccucugcugcaccucgugcuguuuccuuugccgauaacaaugauauaacaaauacaaaccugucucgagguagaggacguaauccaaaaccacgagcugcaccaaauaacacugucucuugguacacugggcuuacccaacacgggaaagucccucuuaccuuuccaccugggcaggguguaccucuuaaugccaauucuaccccugcgcaaaaugcuggguauuggcggagacaggauagaaaaauuaauaccgggaauggaauuaagcaacuggcucccaggugguacuucuacuacacuggaacuggacccgaagcagcacucccauuccgggcuguuaaggauggcaucguuuggguccaugaagauggcgccacugaugcuccuucaacuuuugggacgcggaauccuaacaaugauucagcuauuguuacacaauucgcgcccgguacuaagcuuccuaaaaacuuccacauugaggggacuggaggcaauagucaaucaucuucaagagccucuagcguaagcagaaacucuuccagaucuaguucacaagguucaagaucaggaaacucuacccgcggcacuucuccagguccaucuggaaucggagcaguaggaggugaucuacuuuaccuugaucuucugaacagacuacaagcccuugagucuggcaaaguaaagcaaucgcagccaaaaguaaucacuaagaaagaugcugcugcugcuaaaaauaagaugcgccacaagcgcacuuccaccaaaaguuucaacauggugcaagcuuuuggucuucgcggaccaggagaccuccagggaaacuuuggugaucuucaauugaauaaacucggcacugaggacccacguuggccccaaauugcugagcuugcuccuacagccagugcuuuuauggguaugucgcaauuuaaacuuacccaucagaacaaugaugaucauggcaacccuguauacuuccuucgguacaguggagccauuaaacuugacccaaagaaucccaacuacaauaagugguuggagcuucuugagcaaaauauugaugccuacaaaaccuucccuaagaaggaaaacaaacaaaaggcaccaaaagaagaaucaacagaccaaaugucugaaccuccaaaggagcagcgugugcaagguagcaucacucagcgcacucgcacccguccaaguguucagccugguccaaugauugauguuaacacugauuag

SEQ ID NO: 296 - RNA, 1242 nt, Artificial Sequence
  derived and/or modified CDS sequence (wt) from MERS-CoV__AHX00738__N
auggcagccccugcugcaccucgugcuguuuccuuugccgauaacaaugauauaacaaauacaaacaugucucgagguagaggacguaauccaaaaccacgagcugcaccaaauaacacugucucuugguacacugggcuuacccaacacgggaaagucccucuuaccuuuccaccugggcaggguguaccucuuaaugccaauuccaccccugcgcaaaaugcuggguauuggcggagacaggacagaaaaauuaauaccgggaauggaauuaagcaacuggcucccaggugguacuucuacuacacuggaacuggacccgaagcagcacucccauuccgggcuguuaaggauggcaucguuuggguccaugaagauggcgccacugaugcuccuucaacuuuugggacgcggaacccuaacaaugauucagcuauuguuacacaauucgcgcccgguacuaagcuuccuaaaaacuuccacauugaggggacuggaggcaauagucaaucaucuucaagagccucuagcguaagcagaaacucuuccagaucuaguucacaagguucaagaucaggaaacucuacccgcggcacuucuccagguccaucuggaaucggagcaguaggaggugaucuacuuuaccuugaucuucugaacagacuacaagcccuugagucuggcaaaguaaagcaaucgcagccaaaaguaaucacuaagaaagaugcugcugcugcuaaaaauaagaugcgccacaagcgcacuuccaccaaaaguuucaacauggugcaagcuuuuggucuucgcggaccaggagaccuccagggaaacuuuggugaucuucaauugaauaaacucggcacugaggacccacguuggccccaaauugcugagcuugcuccuacagccagugcuuuuauggguaugucgcaauuuaaacuuacccaucagaacaaugaugaucauggcaacccuguguacuuccuucgguacaguggagccauuaaacuugacccaaagaaucccaacuacaauaagugguuggagcuucuugagcaaaauauugaugccuacaaaaccuucccuaagaaggaaaagaaacaaaaggcaccaaaagaagaaucaacagaccaaaugucugaaccuccaaaggagcagcgugugcaagguagcaucacucagcgcacucgcacccguccaaguguucagccugguccaaugauugauguuaacacugauuag

SEQ ID NO: 297 - RNA, 1242 nt, Artificial Sequence
  derived and/or modified CDS sequence (wt) from MERS-CoV__AHY22561__N
auggcauccccugcugcaccucgugcuguuuccuuugccgauaacaaugauauaacaaauacaaaccugucucgagguagaggacguaauccaaaaccacgagcugcaccaaauaacacugucucuugguacacugggcuuacccaacacgggaaagucccucuuaccuuuccaccugggcaggguguaccucuuaaugccaauuccaccccugcgcaaaaugcuggguauuggcggagacaggacagaaaaauuaauaccgggaauggaauuaagcaacuggcucccaggugguacuucuacuacacuggaacuggacccgaagcagcacucccauuccgggcuguuaaggauggcaucguuuggguccaugaagauggcgccacugaugcuccuucaacuuuugggacgcggaacccuaacaaugauucagcuauuguuacacaauucgcgcccgguacuaagcuuccuaaaaacuuccacauugaggggacuggaggcaauagucaaucaucuucaagagccucuagcguaagcagaaacucuuccagaucuaguucacaagguucaagaucaggaaacucuacccgcggcacuucuccagguccaucuggaaucggagcaguaggaggugaucuacuuuaccuugaucuucugaacagacuacaagcccuugagucuggcaaaguaaagcaaucgcagccaaaaguaaucacuaagaaagaugcugcugcugcuaaaaauaagaugcgccacaagcgcacuuccaccaaaaguuucaacauggugcaagcuuuuggucuucgcggaccaggagaccuccagggaaacuuuggugaucuucaauugaauaaacucggcacugaggacccacguuggccccaaauugcugagcuugcuccuacagccagugcuuuuauggguaugucgcaauuuaaacuuacccaucagaacaaugaugaucauggcaacccuguguacuuccuucgguacaguggagccauuaaacuugacccaaagaaucccaacuacaauaagugguuggagcuucuugagcaaaauauugaugccuacaaaaccuucccuaagaaggaaaacaaacaaaaggcaccaaaagaagaaucaacagaccaaaugucugaaccuccaaaggagcagcgugugcaagguagcaucacucagcgcacucgcacccguccaaguguucagccugguccaaugauugauguuaacacugauuag

SEQ ID NO: 298 - RNA, 1242 nt, Artificial Sequence
  derived and/or modified CDS sequence (wt) from MERS-CoV__AHY22571__N
auggcagccccugcugcaccucgugcuguuuccuuugccgauaacaaugauauaacaaauacaaaccugucucgagguagaggacguaauccaaaaccacgagcugcaccaaauaacacugucucuugguacacugggcuuacccaacacgggaaagucccucuuaccuuuccaccugggcaggguguaccucuuaaugccaauuccaccccugcgcaaaaugcuggguauuggcggagacaggacagaaaaauuaauaccgggaauggaauuaagcaacuggcucccaggugguacuucuacuacacuggaacuggacccgaagcagcacucccauuccgggcuguuaaggauggcaucguuuggguccaugaagauggcgccacugaugcuccuucaacuuuugggacgcggaacccuaacaaugauucagcuauuguuacacaauucgcgcccgguacuaagcuuccuaaaaacuuccacauugaggggacuggaggcaauagucaaucaucuucaagagccucuagcguaagcagaaacucuuccagaucuaguucacaagguucaagaucacgaaacucuacccgcggcacuucuccagguccaucuggaaucggagcaguaggaggugaucuacuuuaccuugaucuucugaacagacuacaagcccuugagucuggcaaaguaaagcaaucgcagccaaaaguaaucacuaagaaagaugcugcugcugcuaaaaauaagaugcgccacaagcgcacuuccaccaaaaguuucaacauggugcaagcuuuuggucuucgcggaccaggagaccuccagggaaacuuuggugaucuucaauugaauaaacucggcacugaggacccacguuggccccaaauugcugagcuugcuccuacagccagugcuuuuauggguaugucgcaauuuaaacuuacccaucagaacaaugaugaucauggcaacccuguguacuuccuucgguacaguggagccauuaaacuugacccaaagaaucccaacuacaauaagugguuggagcuucuugagcaaaauauugaugccuacaaaaccuucccuaagaaggaaaacaaacaaaaggcaccaaaagaagaaucaacagaccaaaugucugaaccuccaaaggagcagcgugugcaagguagcaucacucagcgcacucgcacccguccaaguguucagccugguccaaugauugauguuaacacugauuag

SEQ ID NO: 299 - RNA, 1242 nt, Artificial Sequence
  derived and/or modified CDS sequence (wt) from MERS-CoV__ALA49381__N
auggcauccccugcugcaccucgugcuguuuccuuugccgauaacaaugauauaacaaauacaaaccugucucgagguagaggacguaauccaaaaccacgagcugcaccaaauaacacugucucuugguacacugggcuuacccaacacgggaaagucccucuuaccuuuccaccugggcaggguguaccucuuaaugccaauuccaccccugcgcaaaaugcuggguauuggcggagacaggacagaaaaauuaauaccgggaauggaauuaagcaacuggcucccaggugguacuucuacuacacuggaaccggacccgaagcagcacucccauuccgggcuguuaaggauggcaucguuuggguccaugaagauggcgccacugaugcuccuucaacuuuugggacgcggaacccuaacaaugauucagcuauuguuacacaauucgcgcccgguacuaagcuuccuaaaaacuuccacauugaggggacuggaggcaauagucaaucaucuucaagagccucuagcguaagcagaaacucuuccagaucuaguucacaagguucaagaucaggaaacucuacccgcggcaguucuccagguccaucuggaaucggagcaguaggaggugaucuacuuuaccuugaucuucugaacagacuacaagcccuugagucuggcaaaguaaagcaaucgcagccaaaaguaaucacuaagaaagaugcugcugcugcuaaaaauaagaugcgccacaagcgcacuuccaccaaaaguuucaacauggugcaagcuuuuggucuucgcggaccaggagaccuccagggaaacuuuggugaucuucaauugaauaaacucggcacugaggacccacguuggccccaaauugcugagcuugcuccuacagcuagugcuuuuauggguaugucgcaauuuaaacuuacccaucagaacaaugaugaucauggcaacccuguguacuuccuucgguacaguggagccauuaaacuugacccaaagaaucccaacuacaauaagugguuggagcuucuugagcaaaauauugaugccuacaaaaccuucccuaagaaggaaaagaaacaaaaggcaccaaaagaagaaucaacagaccaaaugucugaaccuccaaaggagcagcgugugcaagguagcaucacucagcgcacucgcacccguccaaguguucagccugguccaaugauugauguuaacacugauuag

SEQ ID NO: 300 - RNA, 1242 nt, Artificial Sequence
  derived and/or modified CDS sequence (wt) from MERS-CoV__ALA49392__N
auggcauccccugcugcaccucgugcuguuuccuuugccgauaacaaugauauaacaaauacaaaccugucucgagguagaggacguaauccaaaaccacgagcugcaccaaauaacacugucucuugguacacugggcuuacccaacacgggaaagucccucuuaccuuuccaccugggcaggguguaccucuuaaugccaauuccaccccugcgcaaaaugcuggguauuggcggagacaggacagaaaaauuaauaccgggaacggaauuaagcaacuggcucccaggugguacuucuacuacacuggaaccggacccgaagcagcacucccauuccgggcuguuaaggauggcaucguuuggguccaugaagauggcgccacugaugcuccuucaacuuuugggacgcggaacccuaacaaugauucagcuauuguuacacaauucgcgcccgguacuaagcuuccuaaaaacuuccacauugaggggacuggaggcaauagucaaucaucuucaagagccucuagcguaagcagaaacucuuccagaucuaguucacaagguucaagaucaggaaacucuacccgcggcaguucuccagguccaucuggaaucggagcaguaggaggugaucuacuuuaccuugaucuucugaacagacuacaagcccuugagucuggcaaaguaaagcaaucgcagccaaaaguaaucacuaagaaagaugcugcugcugcuaaaaauaagaugcgccacaagcgcacuuccaccaaaaguuucaacauggugcaagcuuuuggucuucgcggaccaggagaccuccagggaaacuuuggugaucuucaauugaauaaacucggcacugaggacccacguuggccccaaauugcugagcuugcuccuacagcuagugcuuuuauggguaugucgcaauuuaaacuuacccaucagaacaaugaugaucauggcaacccuguguacuuccuucgguacaguggagccauuaaacuugacccaaagaaucccaacuacaauaagugguuggagcuucuugagcaaaauauugaugccuacaaaaccuucccuaagaaggaaaagaaacaaaaggcaccaaaagaagaaucaacagaccaaaugucugaaccuccaaaggagcagcgugugcgagguagcaucacucagcgcacucgcacccguccaaguguucagccugguccaaugauugauguuaacacugauuag

SEQ ID NO: 301 - RNA, 1242 nt, Artificial Sequence
  derived and/or modified CDS sequence (wt) from MERS-CoV__ALA49601__N
auggcauccccugcugcaccucgugcuguuuccuuugccgauaacaaugauauaacaaauacaaaccugucucgagguagaggacguaauccaaaaccacgagcugcaccaaauaacacugucucuugguacacugggcuuacccaacacgggaaagucccucuuaccuuuccaccugggcaggguguaccucuuaaugccaauuccaccccugcgcaaaaugcuggguauuggcggagacaggacagaaaaauuaauaccgggaauggaauuaagcaacuggcucccaggugguacuucuacuacacuggaacuggacccgaagcagcacucccauuccgggcuguuaaggauggcaucguuuggguccaugaagauggcgccacugaugcuccuucaacuuuugggacgcggaacccuaacaaugauucagcuauuguuacacaauucgcgcccgguacuaagcuuccuaaaaacuuccacauugaggggacuggaggcaauagucaaucaucuucaagagccucuagcguaagcagaaacucuuccagaucuaguucacaagguucaagaucaggaaacucuacccgcggcacuucuccaggucuaucuggaaucggagcaguaggaggugaucuacuuuaccuugaucuucugaacagacuacaagcccuugagucuggcaaaguaaagcaaucgcagccaaaaguaaucacuaagaaagaugcugcugcugcuaaaaauaagaugcgccacaagcgcacuuccaccaaaaguuucaacauggugcaagcuuuuggucuucgcggaccaggagaccuccagggaaacuuuggugaucuucaauugaauaaacucggcacugaggacccacguuggccccaaauugcugagcuugcuccuacagccagugcuuuuauggguaugucgcaauuuaaacuuacccaucagaacaaugaugaucauggcaacccuguguacuuccuucgguacaguggagccauuaaacuugacccaaagaaucccaacuacaauaagugguuggagcuucuugagcaaaauauugaugccuacaaaaccuucccuaagaaggaaaagaaacaaaaggcaccaaaagaagaaucaacagaccaaaugucugaaccuccaaaggagcagcgugugcaagguagcaucacucagcgcacucgcacccguccaaguguucagccugguccaaugauugauguuaacacugauuag

SEQ ID NO: 302 - RNA, 1242 nt, Artificial Sequence
  derived and/or modified CDS sequence (wt) from MERS-CoV__ALA49843__N
auggcauccccugcugcaccucgugcuguuuccuuugccgauaacaaugauauaacaaauacaaaccugucucgagguagaggacguaauccaaaaccacgagcugcaccaaauaacacugucucuugguacacugggcuuacccaacacgggaaagucccucuuaccuuuccaccugggcaggguguaccucuuaaugccaauuccaccccugcgcaaaaugcuggguauuggcggagacaggacagaaaaauuaauaccgggaauggaauuaagcaacuggcucccaggugguacuucuacuacacuggaacuggacccgaagcagcacucccauuccgggcuguuaaggauggcaucguuuggguccaugaagauggcgccacugaugcuccuucaacuuuugggacgcggaacccuaacaaugauucagcuauuguuacacaauucgcgcccgguacuaagcuuccuaaaaacuuccacauugaggggacuggaggcaauagucaaucaucuucaagagccucuagcguaagcagaaacucuuccagaucuaguucacaagguucaagaucaggaaacucuacccgcugcacuucuccagguccaucuggaaucggagcaguaggaggugaucuacuuuaccuugaucuucugaacagacuacaagcccuugagucuggcaaaguaaagcaaucgcagccaaaaguaaucacuaagaaagaugcugcugcugcuaaaaauaagaugcgccacaagcgcacuuccaccaaaaguuucaacauggugcaagcuuuuggucuucgcggaccaggagaccuccagggaaacuuuggugaucuucaauugaauaaacucggcacugaggacccacguuggccccaaauugcugagcuugcuccuacagccagugcuuuuauggguaugucgcaauuuaaacuuacccaucagaacaaugaugaucauggcaacccuguguacuuccuucgguacaguggagccauuaaacuugacccaaagaaucccaacuacaauaagugguuggagcuucuugagcaaaauauugaugccuacaaaaccuucccuaagaaggaaaagaaacaaaaggcaccaaaagaagaaucaacagaccaaaugucugaaccuccaaaggagcagcgugugcaagguagcaucacucagcgcacucgcacccguccaaguguucagccugguccaaugauugauguuaacacugauuag

SEQ ID NO: 303 - RNA, 1242 nt, Artificial Sequence
  derived and/or modified CDS sequence (wt) from MERS-CoV__ALA49865__N
auggcauccccugcugcaccucgugcuguuuccuuugccgauaacaaugauauaacaaauacaaaccugucucgagguagaggacguaauccaaaaccacgagcugcaccaaauaacacugucucuugguacacugggcuuacccaacacgggaaagucccucuuaccuuuccaccugggcaggguguaccucuuaaugccaauuccaccccugcgcaaaaugcuggguauuggcggagacaggacagaaaaauuaauaccgggaauggaauuaagcaacuggcucccaggugguacuucuacuacauuggaacuggacccgaagcagcacucccauuccgggcuguuaaggauggcaucguuuggguccaugaagauggcgccacugaugcuccuucaacuuuugggacgcggaacccuaacaaugauucagcuauuguuacacaauucgcgcccgguacuaagcuuccuaaaaacuuccacauugaggggacuggaggcaauagucaaucaucuucaagagccucuagcguaagcagaaacucuuccagaucuaguucacaagguucaagaucaggaaacucuacccgcggcacuucuccagguccaucuggaaucggagcaguaggaggugaucuacuuuaccuugaucuucugaacagacuacaagcccuugagucuggcaaaguaaagcaaucgcagccaaaaguaaucacuaagaaagaugcugcugcugcuaaaaauaagaugcgccacaagcgcacuuccaccaaaaguuucaacauggugcaagcuuuuggucuucgcggaccaggagaccuccagggaaacuuuggugaucuucaauugaauaaacucggcacugaggacccacguuggccccaaauugcugagcuugcuccuacagccagugcuuuuauggguaugucgcaauuuaaacuuacccaucagaacaaugaugaucauggcaacccuguguacuuccuucgguacaguggagccauuaaacuugacccaaagaaucccaacuacaauaagugguuggagcuucuugagcaaaauauugaugccuacaaaaccuucccuaagaaggaaaagaaacaaaaggcaccaaaagaagaaucaacagaccaaaugucugaaccuccaaaggagcagcgugugcaagguagcaucacucagcgcacucgcacccguccaaguguucagccugguccaaugauugauguuaacacugauuag

SEQ ID NO: 304 - RNA, 1242 nt, Artificial Sequence
  derived and/or modified CDS sequence (wt) from MERS-CoV__ALA49909__N
auggcauccccugcugcaccucgugcuguuuccuuugccgauaacaaugauauaacaaauacaaaccugucucgagguagaggacguaauccaaaaccacgagcugcaccaaauaacacugucucuugguacacugggcuuacccaacacgggaaagucccucuuaccuuuccaccugggcaggguguaccucuuaaugccaauuccaccccugcgcaaaaugcuggguauuggcggagacaggacagaaaaauuaauaccgggaauggaauuaagcaacuggcucccaggugguacuucuacuacacuggaaccggacccgaggcagcacucccauuccgggcuguuaaggauggcaucguuuggguccaugaacauggcgccacugaugcuccuucaacuuuugggacgcggaacccuaacaaugauucagcuauuguuacacaauucgcgcccgguacuaagcuuccuaaaaacuuccacauugaggggacuggaggcaauagucaaucaucuucaagagccucuagcguaagcagaaacucuuccagaucuaguucacaagguucaagaucaggaaacucuacccgcugcacuucuccagguccaucuggaaucggagcaguaggaggugaucuacuuuaccuugaucuucugaacagacuacaagcccuugagucuggcaaaguaaagcaaucgcagccaaaaguaaucacuaagaaagaugcugcugcugcuaaaaauaagaugcgccacaagcgcacuuccaccaaaaguuucaacauggugcaagcuuuuggucuucgcggaccaggagaccuccagggaaacuuuggugaucuucaauugaauaaacucggcacugaggacccacguuggccccaaauugcugagcuugcuccuacagccagugcuuuuauggguaugucucaauuuaaacuuacccaucagaacaaugaugaucauggcaacccuguguacuuccuucgguacaguggagccauuaaacuugacccaaagaaucccaacuacaauaagugguuggagcuucuugagcaaaauauugaugccuacaaaaccuucccuaagaaggaaaagaaacaaaaggcaccaaaagaagaaucaacagaccaaaugucugaaccuccuaaggagcagcgugugcaagguagcaucacucagcgcacucgcacccguccaaguguucagccugguccaaugauugauguuaacacugauuag

SEQ ID NO: 305 - RNA, 4062 nt, Artificial Sequence
  derived and/or modified CDS sequence (opt1) from MERS-CoV__AFS88936__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccagaaggugcaggacgccgugaacaacaacgcgcaggcccucuccaagcuggccagcgagcuguccaacacguucggcgccaucagcgccuccaucggcgacaucauccagcggcucgacgugcuggagcaggacgcgcagaucgaccgccugaucaacgggcggcucaccacccugaacgccuucgucgcccagcagcuggugcgcagcgaguccgccgcgcucagcgcccagcuggccaaggacaaggugaacgagugcgucaaggcccaguccaagcggagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccgcaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccggugcugcgaccgcuacgaggaguacgaccucgagccccacaaggugcacguccacuga

SEQ ID NO: 306 - RNA, 4062 nt, Artificial Sequence
  derived and/or modified CDS sequence (opt1) from MERS-CoV__AFY13307__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccgguuccucuccgacgaccgcaccgaggucccccagcuggugaacgccaaccaguacagccccugcguguccaucguccccagcacggugugggaggacggggacuacuaccggaagcagcugagcccgcucgagggcggcggguggcugguggccuccggcagcaccgucgcgaugaccgagcagcugcagaugggguucggcaucaccgugcaguacgggaccgacacgaacuccgugugccccaagcucgaguucgccaacgacaccaagaucgccagccagcugggcaacugcgucgaguacucccuguacggcgugagcgggcgcggcguguuccagaacugcaccgccgucggggugcggcagcagcgcuucguguacgacgcguaccagaaccucgucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcugaagcggcgcgacuccacguacggcccgcuccagacccccgucgggugcgugcugggccuggugaacagcucccucuucgucgaggacugcaagcugccccuggggcagagccucugcgcccugcccgacaccccgagcacccugacgccccgguccgugcgcagcgugcccggcgagaugcggcucgcguccaucgccuucaaccaccccauccaggucgaccagcugaacagcuccuacuucaagcugagcaucccgaccaacuucuccuucggcgugacccaggaguacauccagaccacgauccagaaggugaccgucgacugcaagcaguacgugugcaacggguuccagaagugcgagcagcuccugcgcgaguacggccaguucugcagcaagaucaaccaggcccugcacggggccaaccuccggcaggacgacuccgugcgcaaccuguucgccagcgucaaguccagccaguccagccccaucauccccggcuucgggggcgacuucaaccugacccuccuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcugccgccccucauggacgugaacauggaggccgccuacaccagcucccugcuggggagcaucgcgggcgucggcuggaccgccgggcucuccagcuucgccgccauccccuucgcccaguccaucuucuaccgccugaacggcguggggaucacccagcagguccugagcgagaaccagaagcucaucgcgaacaaguucaaccaggcccugggcgccaugcagacgggguucaccaccaccaacgaggccuuccacaaggugcaggacgccgugaacaacaacgcgcaggcccuguccaagcucgccagcgagcuguccaacacguucggcgccaucagcgccuccaucggcgacaucauccagcggcuggacgugcucgagcaggacgcgcagaucgaccgccugaucaacgggcggcugaccacccucaacgccuucgucgcccagcagcuggugcgcagcgaguccgccgcgcugagcgcccagcucgccaaggacaaggugaacgagugcgucaaggcccaguccaagcggagcggcuucugcgggcagggcacccacaucguguccuucgucgugaacgcccccaacggccuguacuucaugcacgugggguacuaccccagcaaccacaucgaggucguguccgcguacggccugugcgacgccgccaaccccacgaacugcaucgccccggugaacggguacuucaucaagaccaacaacacccgcaucgucgacgaguggagcuacaccggcagcuccuucuacgcccccgagcccaucacgagccucaacaccaaguacguggcgccccaggugaccuaccagaacaucuccaccaaccugccgccgccccugcucgggaacagcaccggcaucgacuuccaggacgagcuggacgaguucuucaagaacgucuccacgagcauccccaacuucggcucccugacccagaucaacaccacccuccuggaccugacguacgagaugcucagccugcagcaggucgugaaggcccugaacgaguccuacaucgaccucaaggagcuggggaacuacaccuacuacaacaaguggcccugguacaucuggcugggcuucaucgccgggcucguggcccuggcccugugcguguucuucauccucugcugcaccggcugcgggaccaacugcaugggcaagcugaagugcaaccggugcugcgaccgcuacgaggaguacgaccuggagccccacaaggugcacguccacuga

SEQ ID NO: 307 - RNA, 4062 nt, Artificial Sequence
  derived and/or modified CDS sequence (opt1) from MERS-CoV__AGH58717__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccgucaccacgccccagaagcuguucguggccaacuacucccaggacgugaagcaguucgccaacggcuucgucgugcgcaucggggccgcggccaacagcaccggcaccgugaucaucucccccagcaccuccgccaccauccggaagaucuaccccgccuucaugcuggggagcuccgucggcaacuucagcgacgggaagaugggccgcuucuucaaccacacgcucgugcugcugccggacggcugcgggacccuccugcgggcguucuacugcauccuggagccccgcuccggcaacuacugccccgccgggaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucggcaucacccagaccgcgcagggggugcaccucuucagcucccgguacgucgaccuguacggcgggaacauguuccaguucgccacccugccgguguacgacacgaucaaguacuacagcaucaucccccacuccauccucagcauccaguccgaccgcaaggccugggccgccuucuacguguacaagcugcagccccugaccuuccuccuggacuucagcgucgacggcuacauccggcgcgcgaucgacugcggguucaacgaccugucccagcuccacugcagcuacgaguccuucgacguggagagcggcguguacuccgucagcuccuucgaggccaagcccagcggcuccgugguggagcaggccgagggggucgagugcgacuucagcccgcugcuguccggcaccccgccccagguguacaacuucaagcggcucgucuucaccaacugcaacuacaaccugacgaagcugcucagccuguucuccgugaacgacuucacgugcagccagaucagccccgccgccaucgcguccaacugcuacagcucccugauccucgacuacuucagcuacccccuguccaugaaguccgaccugagcgugagcuccgccgggcccaucagccaguucaacuacaagcaguccuucagcaacccgaccugccucauccuggccaccgucccccacaaccugaccaccaucaccaagccccucaaguacuccuacaucaacaagugcagccgccugcuguccgacgaccggaccgaggugccccagcucgugaacgccaaccaguacagccccugcgucuccaucgugcccagcacggugugggaggacggggacuacuaccgcaagcagcugagcccgcuggagggcgggggcuggcucgucgccuccgggagcaccguggcgaugaccgagcagcugcagaugggcuucgggaucaccgugcaguacggcaccgacacgaacuccgucugccccaagcuggaguucgccaacgacaccaagaucgccagccagcucgggaacugcguggaguacucccuguacggcgugagcggccgcggggucuuccagaacugcaccgccgugggcgugcggcagcagcgguucgucuacgacgcguaccagaaccuggugggguacuacuccgacgacggcaacuacuacugccugcgcgccugcgugagcguccccguguccgugaucuacgacaaggagaccaagacgcacgccacccucuucggcagcgucgccugcgagcacaucuccagcaccaugucccaguacagccgguccacccgcagcaugcugaagcgccgggacuccacguacgggccgcugcagacccccgugggcugcgugcucgggcuggucaacagcucccuguucguggaggacugcaagcucccccugggccagagccugugcgcccuccccgacaccccgagcacccugacgccccgcuccgugcggagcguccccggggagaugcgccuggcguccaucgccuucaaccaccccauccagguggaccagcucaacagcuccuacuucaagcugagcaucccgaccaacuucuccuucggcgugacccaggaguacauccagaccacgauccagaaggucaccguggacugcaagcaguacgugugcaacggcuuccagaagugcgagcagcugcuccgggaguacgggcaguucugcagcaagaucaaccaggcccugcacggcgccaaccugcgccaggacgacuccguccggaaccucuucgccagcgugaaguccagccaguccagccccaucauccccggguucggcggggacuucaaccugacccugcucgagcccguguccaucagcaccggcucccgcagcgcgcgguccgccaucgaggaccugcuguucgacaaggucacgaucgccgacccgggcuacaugcagggguacgacgacugcaugcagcagggccccgccagcgcccgcgaccucaucugcgcgcaguacguggccggguacaaggugcugccgccccugauggacgucaacauggaggccgccuacaccagcucccuccugggcagcaucgcgggggugggcuggaccgccggccuguccagcuucgccgccauccccuucgcccaguccaucuucuaccggcucaacggggugggcaucacccagcagguccugagcgagaaccagaagcugaucgcgaacaaguucaaccaggcccucggggccaugcagacgggcuucaccaccaccaacgaggccuuccagaaggugcaggacgccgugaacaacaacgcgcaggcccuguccaagcuggccagcgagcucuccaacacguucggggccaucagcgccuccaucggcgacaucauccagcgccuggacguccuggagcaggacgcgcagaucgaccggcucaucaacggccgccugaccacccugaacgccuucguggcccagcagcucgugcggagcgaguccgccgcgcugagcgcccagcuggccaaggacaaggucaacgagugcgugaaggcccaguccaagcgcagcggguucugcggccaggggacccacaucgucuccuucguggugaacgcccccaacggccucuacuucaugcacgucggcuacuaccccagcaaccacaucgaggugguguccgcguacgggcugugcgacagcgccaaccccacgaacugcaucgccccggucaacggcuacuucaucaagaccaacaacacccggaucguggacgaguggagcuacaccggguccagcuucuacgcccccgagcccaucacgucccugaacaccaaguacguggcgccccaggucaccuaccagaacaucagcaccaaccucccgccgccccugcugggcaacuccaccgggaucgacuuccaggacgagcucgacgaguucuucaagaacgugagcacguccauccccaacuucggcagccugacccagaucaacaccacccugcucgaccugacguacgagaugcugucccuccagcaggucgugaaggcccugaacgagagcuacaucgaccugaaggagcucggcaacuacaccuacuacaacaaguggcccugguacaucuggcugggguucaucgccggccugguggcccucgcccugugcguguucuucauccugugcugcaccgggugcggcaccaacugcauggggaagcucaagugcaaccgcugcugcgaccgguacgaggaguacgaccuggagccccacaagguccacgugcacuga

SEQ ID NO: 308 - RNA, 4062 nt, Artificial Sequence
  derived and/or modified CDS sequence (opt1) from MERS-CoV__AGN52936__S
augauccacagcguguuccugcucauguuccugcugacccccaccgaguccuacgucgacgugggcccggacagcaucaaguccgccugcaucgagguggacauccagcagacguucuucgacaagaccuggccccgccccaucgacgucagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucguggccaacuacucccaggacgucaagcaguucgccaacggguucguggugcgcaucggcgccgcggccaacagcaccgggaccgucaucaucucccccagcaccuccgccaccauccggaagaucuaccccgccuucaugcugggcagcuccguggggaacuucagcgacggcaagaugggccgcuucuucaaccacacgcucgugcugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcguccaccucuucagcucccgguacguggaccuguacgggggcaacauguuccaguucgccacccugccgguguacgacacgaucaaguacuacagcaucaucccccacuccauccgcagcauccaguccgaccggaaggccugggccgccuucuacgucuacaagcuccagccccugaccuuccugcucgacuucagcguggacggguacauccgccgggcgaucgacugcggcuucaacgaccugucccagcugcacugcagcuacgaguccuucgacguggagagcggcgucuacuccgugagcuccuucgaggccaagcccagcggguccguggucgagcaggccgagggcguggagugcgacuucagcccgcuccuguccgggaccccgccccagguguacaacuucaagcgccuggucuucaccaacugcaacuacaaccucacgaagcugcugagccucuucuccgugaacgacuucacgugcagccagaucagccccgccgccaucgcguccaacugcuacagcucccugauccuggacuacuucagcuacccccucuccaugaaguccgaccugagcgucagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggugccccagcuggucaacgccaaccaguacagccccugcguguccaucgugcccagcacggucugggaggacggggacuacuaccggaagcagcucagcccgcuggagggcggcggguggcugguggccuccggcagcaccguggcgaugaccgagcagcuccagaugggguucggcaucaccguccaguacgggaccgacacgaacuccgugugccccaagcuggaguucgccaacgacaccaagaucgccagccagcugggcaacugcguggaguacucccucuacggcgucagcgggcgcggcguguuccagaacugcaccgccguggggguccggcagcagcgcuucguguacgacgcguaccagaaccuggugggcuacuacuccgacgacggcaacuacuacugccugcgggccugcgucagcgugcccguguccgucaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccguggggugcguccugggccucgugaacagcucccuguucguggaggacugcaagcugccccucgggcagagccugugcgcccugcccgacaccccgagcacccucacgccccgguccguccgcagcgugcccggcgagaugcggcuggcguccaucgccuucaaccaccccauccagguggaccagcugaacagcuccuacuucaagcucagcaucccgaccaacuucuccuucggcgucacccaggaguacauccagaccacgauccagaaggugaccguggacugcaagcaguacgucugcaacggguuccagaagugcgagcagcugcugcgcgaguacggccaguucugcagcaagaucaaccaggcccuccacggggccaaccugcggcaggacgacuccgugcgcaaccuguucgccagcgugaaguccagccaguccagccccaucauccccggcuucgggggcgacuucaaccucacccugcuggagcccgucuccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacguggccggcuacaagguccucccgccccugauggacgugaacauggaggccgccuacaccagcucccugcucgggagcaucgcgggcgugggcuggaccgccgggcuguccagcuucgccgccauccccuucgcccaguccaucuucuaccgccugaacggcgucgggaucacccagcagguccucagcgagaaccagaagcugaucgcgaacaaguucaaccaggcccugggcgccaugcagacgggguucaccaccaccaacgaggccuuccacaaggugcaggacgccgugaacaacaacgcgcaggcccucuccaagcuggccagcgagcuguccaacacguucggcgccaucagcgccuccaucggcgacaucauccagcggcucgacgugcuggagcaggacgcgcagaucgaccgccugaucaacgggcggcucaccacccugaacgccuucguggcccagcagcugguccgcagcgaguccgccgcgcucagcgcccagcuggccaaggacaaggugaacgagugcgugaaggcccaguccaagcggagcggcuucugcgggcagggcacccacaucgucuccuucguggucaacgcccccaacggccuguacuucaugcacgugggguacuaccccagcaaccacaucgagguggucuccgcguacggccucugcgacgccgccaaccccacgaacugcaucgccccggugaacggguacuucaucaagaccaacaacacccgcaucguggacgaguggagcuacaccggcagcuccuucuacgcccccgagcccaucacgagccugaacaccaaguacgucgcgccccaggugaccuaccagaacaucuccaccaaccugccgccgccccuccuggggaacagcaccggcaucgacuuccaggacgagcuggacgaguucuucaagaacguguccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcgucuucuucauccugugcugcaccggcugcgggaccaacugcaugggcaagcugaagugcaaccggugcugcgaccgcuacgaggaguacgaccucgagccccacaaggugcacgugcacuga

SEQ ID NO: 309 - RNA, 4062 nt, Artificial Sequence
  derived and/or modified CDS sequence (opt1) from MERS-CoV__AGN70951__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccagcgccucgacgugcuggagcaggacgcgcagaucgaccggcugaucaacgggcgccucaccacccugaacgccuucgucgcccagcagcuggugcggagcgaguccgccgcgcucagcgcccagcuggccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccggaucgucgacgaguggagcuacaccggcagcuccuucuacgcccccgagcccaucacgagccugaacaccaaguacguggcgccccacgugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 310 - RNA, 4062 nt, Artificial Sequence
  derived and/or modified CDS sequence (opt1) from MERS-CoV__AGV08408__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccggggaccgcaccgaggucccccagcuggugaacgccaaccaguacagccccugcguguccaucguccccagcacggugugggaggacggcgacuacuaccggaagcagcucagcccgcuggagggcgggggcuggcugguggccuccgggagcaccgucgcgaugaccgagcagcuccagaugggcuucgggaucaccgugcaguacggcaccgacacgaacuccgugugccccaagcuggaguucgccaacgacaccaagaucgccagccagcugggcaacugcgucgaguacucccucuacggggugagcggccgcgggguguuccagaacugcaccgccgucggcgugcggcagcagcgcuucguguacgacgcguaccagaaccuggucggcuacuacuccgacgacgggaacuacuacugccugcgggccugcgugagcgugcccgucuccgugaucuacgacaaggagaccaagacgcacgccacccuguucggcagcguggccugcgagcacaucuccagcaccaugucccaguacagccgcuccacccgcagcaugcucaagcggcgcgacuccacguacgggccgcugcagacccccgucggcugcgugcuggggcucgugaacagcucccuguucgucgaggacugcaagcugccccucggccagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggggugacccaggaguacauccagaccacgauccagaaggugaccgucgacugcaagcaguacgugugcaacggcuuccagaagugcgagcagcugcugcgcgaguacgggcaguucugcagcaagaucaaccaggcccuccacggcgccaaccugcggcaggacgacuccgugcgcaaccuguucgccagcgucaaguccagccaguccagccccaucauccccggguucggcggcgacuucaaccucacccugcuggagcccguguccaucagcaccgggucccggagcgcgcgcuccgccaucgaggaccuccuguucgacaaggugacgaucgccgacccgggcuacaugcagggguacgacgacugcaugcagcagggccccgccagcgcccgggaccugaucugcgcgcaguacgucgccggguacaaggugcucccgccccugauggacgugaacauggaggccgccuacaccagcucccugcucggcagcaucgcgggcgucggguggaccgccggccuguccagcuucgccgccauccccuucgcccaguccaucuucuaccgccugaacggggugggcaucacccagcagguccucagcgagaaccagaagcugaucgcgaacaaguucaaccaggcccugggggccaugcagacgggcuucaccaccaccaacgaggccuuccggaaggugcaggacgccgugaacaacaacgcgcaggcccucuccaagcuggccagcgagcuguccaacacguucggcgccaucagcgccuccaucggggacaucauccagcgccucgacgugcuggagcaggacgcgcagaucgaccggcugaucaacggccgccucaccacccugaacgccuucgucgcccagcagcuggugcggagcgaguccgccgcgcucagcgcccagcuggccaaggacaaggugaacgagugcgucaaggcccaguccaagcgcagcggguucugcggccagggcacccacaucguguccuucgucgugaacgcccccaacgggcuguacuucaugcacgugggcuacuaccccagcaaccacaucgaggucguguccgcguacgggcucugcgacgccgccaaccccacgaacugcaucgccccggugaacggcuacuucaucaagaccaacaacacccggaucgucgacgaguggagcuacaccgggagcuccuucuacgcccccgagcccaucacgagccugaacaccaaguacguggcgccccaggugaccuaccagaacaucuccaccaaccugccgccgccccuccugggcaacagcaccggcaucgacuuccaggacgagcuggacgaguucuucaagaacgucuccacgagcauccccaacuucgggucccucacccagaucaacaccacccugcuggaccucacguacgagaugcugagccugcagcaggucgugaaggcccucaacgaguccuacaucgaccugaaggagcugggcaacuacaccuacuacaacaaguggcccugguacaucuggcucggguucaucgccggccugguggcccuggcccucugcguguucuucauccugugcugcaccgggugcggcaccaacugcaugggcaagcugaagugcaaccgcugcugcgaccgcuacgaggaguacgaccucgagccccacaaggugcacguccacuga

SEQ ID NO: 311 - RNA, 4062 nt, Artificial Sequence
  derived and/or modified CDS sequence (opt1) from MERS-CoV__AGV08455__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcuacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccagcgccucgacgugcuggagcaggacgcgcagaucgaccggcugaucaacgggcgccucaccacccugaacgccuucgucgcccagcagcuggugcggagcgaguccgccgcgcucagcgcccagcuggccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccggaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 312 - RNA, 4062 nt, Artificial Sequence
  derived and/or modified CDS sequence (opt1) from MERS-CoV__AGV08467__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccagcgccucgacgugcuggagcaggacgcgcagaucgaccggcugaucaacgggcgccucaccacccugaacgccuucgucgcccagcagcuggugcggagcgaguccgccgcgcucagcgcccagcuggccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccggaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcaucggcaucgacuuccaggacgagcuggacgaguucuucaagaacgucuccaccagcauccccaacuucggcucccucacgcagaucaacaccacccugcuggaccucaccuacgagaugcugagccugcagcaggucgugaaggcccucaacgaguccuacaucgaccugaaggagcuggggaacuacacguacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 313 - RNA, 4062 nt, Artificial Sequence
  derived and/or modified CDS sequence (opt1) from MERS-CoV__AGV08492__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccagcgccucgacgugcuggagcaggacgcgcagaucgaccggcugaucaacgggcgccucaccacccugaacgccuucgucagccagcagcuggugcgguccgagagcgccgcccucuccgcgcagcuggccaaggacaaggugaacgagugcgucaaggcccagagcaagcgcuccggcuucugcgggcagggcacccacaucgugagcuucgucgugaacgcccccaacggccuguacuucaugcacgugggguacuaccccuccaaccacaucgaggucgugagcgccuacggccucugcgacgcggccaaccccacgaacugcaucgccccggugaacggguacuucaucaagaccaacaacacccggaucgucgacgaguggagcuacaccggcuccagcuucuacgcccccgagcccaucacgucccugaacaccaaguacguggcgccccacgugaccuaccagaacaucagcaccaaccugccgccgccccuccuggggaacuccaccggcaucgacuuccaggacgagcuggacgaguucuucaagaacgucagcacguccauccccaacuucggcagccucacccagaucaacaccacccugcuggaccucacguacgagaugcugucccugcagcaggucgugaaggcccucaacgagagcuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 314 - RNA, 4062 nt, Artificial Sequence
  derived and/or modified CDS sequence (opt1) from MERS-CoV__AGV08584__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggccugggaggacggggacuacuaccggaagcagcucagcccgcuggagggcggcggguggcugguggcguccggcagcaccguggccaugaccgagcagcuccagaugggguucggcaucaccguccaguacgggaccgacacgaacuccgugugccccaagcuggaguucgccaacgacaccaagaucgccagccagcugggcaacugcguggaguacucccucuacggcgucagcgggcgcggcguguuccagaacugcaccgcgguggggguccggcagcagcgcuucguguacgacgccuaccagaaccuggugggcuacuacuccgacgacggcaacuacuacugccugcgggccugcgucagcgugcccguguccgucaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccguggggugcguccugggccucgugaacagcucccuguucguggaggacugcaagcugccccucgggcagagccugugcgcgcugcccgacaccccgagcacccucacgccccgguccguccgcagcgugcccggcgagaugcggcuggccuccaucgccuucaaccaccccauccagguggaccagcugaacagcuccuacuucaagcucagcaucccgaccaacuucuccuucggcgucacccaggaguacauccagaccacgauccagaaggugaccguggacugcaagcaguacgucugcaacggguuccagaagugcgagcagcugcugcgcgaguacggccaguucugcagcaagaucaaccaggcccuccacggggccaaccugcggcaggacgacuccgugcgcaaccuguucgcgagcgugaaguccagccaguccagccccaucauccccggcuucgggggcgacuucaaccucacccugcuggagcccgucuccaucagcaccggcucccggagcgcccgcuccgccaucgaggaccuccuguucgacaaggugacgaucgccgacccgggguacaugcagggcuacgacgacugcaugcagcaggggcccgccagcgcgcgggaccugaucugcgcccaguacguggccggcuacaagguccucccgccccugauggacgugaacauggaggccgcguacaccagcucccugcucgggagcaucgccggcgugggcuggaccgccgggcuguccagcuucgccgccauccccuucgcgcaguccaucuucuaccgccugaacggcgucgggaucacccagcagguccucagcgagaaccagaagcugaucgccaacaaguucaaccaggcccugggcgccaugcagacgggguucaccaccaccaacgaggccuuccggaaggugcaggacgcggugaacaacaacgcccaggcccucuccaagcuggccagcgagcuguccaacacguucggcgccaucagcgcguccaucggcgacaucauccagcgccucgacgugcuggagcaggacgcccagaucgaccggcugaucaacgggcgccucaccacccugaacgccuucguggcccagcagcugguccggagcgaguccgcggcccucagcgcccagcuggccaaggacaaggugaacgagugcgugaaggcccaguccaagcgcagcggcuucugcgggcagggcacccacaucgucuccuucguggucaacgcgcccaacggccuguacuucaugcacgugggguacuaccccagcaaccacaucgagguggucuccgccuacggccucugcgacgccgccaaccccacgaacugcaucgccccggugaacggguacuucaucaagaccaacaacacccggaucguggacgaguggagcuacaccggcagcuccuucuacgcgcccgagcccaucacgagccugaacaccaaguacgucgcgccccaggugaccuaccagaacaucuccaccaaccugccgccgccccuccuggggaacagcaccggcaucgacuuccaggacgagcuggacgaguucuucaagaacguguccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcgucuucuucauccugugcugcaccggcugcgggaccaacugcaugggcaagcugaagugcaaccgcugcugcgaccgcuacgaggaguacgaccucgagccccacaaggugcacgugcacuga

SEQ ID NO: 315 - RNA, 4062 nt, Artificial Sequence
  derived and/or modified CDS sequence (opt1) from MERS-CoV__AHB33326__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccuacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcaccaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccagcgccucgacgugcuggagcaggacgcgcagaucgaccggcugaucaacgggcgccucaccacccugaacgccuucgucgcccagcagcuggugcggagcgaguccgccgcgcucagcgcccagcuggccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccggaucgucgacgaguggagcuacaccggcagcuccuucuacagccccgagcccaucacgucccugaacaccaaguacguggcgccccaggugaccuaccagaacaucagcaccaaccugccgccgccccuccuggggaacuccaccggcaucgacuuccaggacgagcuggacgaguucuucaagaacgucagcacguccauccccaacuucggcagccucacccagaucaacaccacccugcuggaccucacguacgagaugcugucccugcagcaggucgugaaggcccucaacgagagcuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 316 - RNA, 4062 nt, Artificial Sequence
  derived and/or modified CDS sequence (opt1) from MERS-CoV__AHC74088__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuucgccgggcccaucucccaguucaacuacaagcagagcuucuccaacccgaccugccugauccucgccaccgugccccacaaccugaccaccaucaccaagccccugaaguacagcuacaucaacaagugcucccggcuccugagcgacgaccgcaccgaggucccccagcuggugaacgccaaccaguacucccccugcgugagcaucguccccuccacggugugggaggacggggacuacuaccggaagcagcucagcccgcuggagggcggcggguggcugguggccagcggcuccaccgucgcgaugaccgagcagcuccagaugggguucggcaucaccgugcaguacgggaccgacacgaacagcgugugccccaagcuggaguucgccaacgacaccaagaucgccucccagcugggcaacugcgucgaguacagccucuacggcguguccgggcgcggcguguuccagaacugcaccgccgucggggugcggcagcagcgcuucguguacgacgcguaccagaaccuggucggcuacuacagcgacgacggcaacuacuacugccugcgggccugcguguccgugcccgucagcgugaucuacgacaaggagaccaagacgcacgccacccuguucggguccguggccugcgagcacaucagcuccaccaugagccaguacucccgcagcacccgcuccaugcucaagcggcgcgacagcacguacggcccgcugcagacccccgucgggugcgugcugggccucgugaacuccagccuguucgucgaggacugcaagcugccccucgggcagucccugugcgcccugcccgacaccccgagcacccucacgccccggagcgugcgcuccgugcccggcgagaugcggcuggcgagcaucgccuucaaccaccccauccaggucgaccagcugaacuccagcuacuucaagcucuccaucccgaccaacuucagcuucggcgugacccaggaguacauccagaccacgauccagaaggugaccgucgacugcaagcaguacgugugcaacggguuccagaagugcgagcagcugcugcgcgaguacggccaguucugcuccaagaucaaccaggcccuccacggggccaaccugcggcaggacgacagcgugcgcaaccuguucgccuccgucaagagcucccagagcucccccaucauccccggcuucgggggcgacuucaaccucacccugcuggagcccgugagcaucuccaccggcagccgguccgcgcgcagcgccaucgaggaccuccuguucgacaaggugacgaucgccgacccgggguacaugcagggcuacgacgacugcaugcagcaggggcccgccuccgcccgggaccugaucugcgcgcaguacgucgccggcuacaaggugcucccgccccugauggacgugaacauggaggccgccuacaccagcagccugcucggguccaucgcgggcgucggcuggaccgccgggcugagcuccuucgccgccauccccuucgcccagagcaucuucuaccgccugaacggcguggggaucacccagcagguccucuccgagaaccagaagcugaucgcgaacaaguucaaccaggcccugggcgccaugcagacgggguucaccaccaccaacgaggccuuccggaaggugcaggacgccgugaacaacaacgcgcaggcccucagcaagcuggccuccgagcugagcaacacguucggcgccaucuccgccagcaucggcgacaucauccagcgccucgacgugcuggagcaggacgcgcagaucgaccggcugaucaacgggcgccucaccacccugaacgccuucgucgcccagcagcuggugcgguccgagagcgccgcgcucuccgcccagcuggccaaggacaaggugaacgagugcgucaaggcccagagcaagcgcuccggcuucugcgggcagggcacccacaucgugagcuucgucgugaacgcccccaacggccuguacuucaugcacgugggguacuaccccuccaaccacaucgaggucgugagcgcguacggccucugcgacgccgccaaccccacgaacugcaucgccccggugaacggguacuucaucaagaccaacaacacccggaucgucgacgagugguccuacaccggcagcagcuucuacgcccccgagcccaucacgucccugaacaccaaguacguggcgccccaggugaccuaccagaacaucagcaccaaccugccgccgccccuccuggggaacuccaccggcaucgacuuccaggacgagcuggacgaguucuucaagaacgucagcacguccauccccaacuucggcagccucacccagaucaacaccacccugcuggaccucacguacgagaugcugucccugcagcaggucgugaaggcccucaacgagagcuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 317 - RNA, 4062 nt, Artificial Sequence
  derived and/or modified CDS sequence (opt1) from MERS-CoV__AHI48528__S
augauccacagcguguuccugcucauguuccugcugacccccaccgaguccuacgucgacgugggccccgacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagcccgcccgccaucgccuccaacugcuacagcucccugauccuggacuacuucagcuacccccucuccaugaaguccgaccugagcgugagcuccgcggggcccaucagccaguucaacuacaagcaguccuucagcaacccgaccugccugauccucgugaccgucccccacaaccugaccaccaucaccaagccccugaaguacuccuacaucaacaagugcagccggcuccuguccgacgaccgcaccgaggugccccagcuggugaacgccaaccaguacagccccugcgucuccaucgugccgagcacggugugggaggacggggacuacuaccggaagcagcucagcccccuggagggcggcggguggcuggucgccuccggcagcaccguggccaugaccgagcagcuccagaugggguucggcaucaccgugcaguacgggaccgacacgaacuccgucugccccaagcuggaguucgccaacgacaccaagaucgcgagccagcugggcaacugcguggaguacucccucuacggcgugagcgggcgcggcgucuuccagaacugcaccgccgugggggugcggcagcagcgcuucgucuacgacgccuaccagaaccuggugggcuacuacuccgacgacggcaacuacuacugccugcgggccugcgugagcgucccgguguccgugaucuacgacaaggagaccaagacgcacgcgacccuguucgggagcgucgccugcgagcacaucuccagcaccaugucccaguacagccgcuccacccgcagcaugcucaagcggcgcgacuccacguacggcccccugcagacccccguggggugcgugcugggccucgucaacagcucccuguucguggaggacugcaagcugccccucgggcagagccugugcgcccugccggacacccccagcacccucacgccccgguccgugcgcagcguccccggcgagaugcggcuggccuccaucgccuucaaccacccgauccagguggaccagcugaacagcuccuacuucaagcucagcauccccaccaacuucuccuucggcgugacccaggaguacauccagaccacgauccagaaggucaccguggacugcaagcaguacgugugcaacggguuccagaagugcgagcagcugcugcgcgaguacggccaguucugcagcaagaucaaccaggcgcuccacggggccaaccugcggcaggacgacuccguccgcaaccuguucgccagcgugaaguccagccaguccagccccaucauccccggcuucgggggcgacuucaaccucacccugcuggagccgguguccaucagcaccggcucccggagcgcccgcuccgccaucgaggaccuccuguucgacaaggucacgaucgcggaccccggguacaugcagggcuacgacgacugcaugcagcaggggcccgccagcgcccgggaccugaucugcgcccaguacguggccggcuacaaggugcugcccccgcucauggacgucaacauggaggcggccuacaccagcucccugcucgggagcaucgccggcgugggcuggaccgccgggcuguccagcuucgcggccauccccuucgcccaguccaucuucuaccgccugaacggcguggggaucacccagcagguccucagcgagaaccagaagcugaucgccaacaaguucaaccaggcccugggcgcgaugcagacgggguucaccaccaccaacgaggccuuccggaaggugcaggacgccgugaacaacaacgcccaggcccucuccaagcuggcgagcgagcuguccaacacguucggcgccaucagcgccuccaucggcgacaucauccagcgccucgacguccuggagcaggacgcccagaucgaccggcugaucaacgggcgccucaccacccugaacgccuucguggcgcagcagcuggugcggagcgaguccgccgcccucagcgcccagcuggcgaaggacaaggucaacgagugcgugaaggcccaguccaagcgcagcggcuucugcgggcagggcacccacaucgucuccuucguggugaacgcccccaacggccuguacuucaugcacgucggguacuaccccagcaaccacaucgaggugguguccgccuacggccucugcgacgccgcgaacccgacgaacugcaucgcccccgucaacggguacuucaucaagaccaacaacacccggaucguggacgaguggagcuacaccggcagcuccuucuacgcccccgagcccaucacgagccugaacaccaaguacguggccccgcaggucaccuaccagaacaucuccaccaaccugcccccgccccuccuggggaacagcaccggcaucgacuuccaggacgagcuggacgaguucuucaagaacguguccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgcggggcugguggcccuggcccucugcguguucuucauccugugcugcaccggcugcgggaccaacugcaugggcaagcugaagugcaaccgcugcugcgaccgcuacgaggaguacgaccucgagccccacaagguccacgugcacuga

SEQ ID NO: 318 - RNA, 4062 nt, Artificial Sequence
  derived and/or modified CDS sequence (opt1) from MERS-CoV__AHI48550__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccacaaggugcaggacgccgugaacaacaacgcgcaggcccucuccaagcuggccagcgagcuguccaacacguucggcgccaucagcgccuccaucggcgacaucauccagcggcucgacgugcuggagcaggacgcgcagaucgaccgccugaucaacgggcggcucaccacccugaacgccuucgucgcccagcagcuggugcgcagcgaguccgccgcgcucagcgcccagcuggccaaggacaaggugaacgagugcgucaaggcccaguccaagcggagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccgcaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccggugcugcgaccgcuacgaggaguacgaccuccagccccacaaggugcacguccacuga

SEQ ID NO: 319 - RNA, 4062 nt, Artificial Sequence
  derived and/or modified CDS sequence (opt1) from MERS-CoV__AHI48583__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacguguucaaggccgacgggaucaucuacccccagggccggaccuacagcaacaucaccaucacguaccagggccucuucccguaccagggcgaccacggggacauguacguguacuccgcgggccacgccaccggcaccacgccccagaagcuguucgucgccaacuacagccaggacgugaagcaguucgccaacggguucgugguccgcaucggcgccgcggccaacuccaccgggaccgugaucaucagccccuccaccagcgccaccauccggaagaucuaccccgccuucaugcugggcuccagcguggggaacuucuccgacggcaagaugggccgcuucuucaaccacacgcucguccugcugccggacgggugcggcacccuccugcgggcguucuacugcauccuggagccccgcagcgggaaccacugccccgccggcaacuccuacaccagcuucgccaccuaccacacgcccgccaccgacugcuccgacggcaacuacaaccggaacgccagccucaacuccuucaaggaguacuucaaccugcgcaacugcaccuucauguacaccuacaacaucacggaggacgagauccuggagugguucgggaucacccagaccgcgcagggcgugcaccucuucagcagccgguacguggaccuguacgggggcaacauguuccaguucgccacccugccggucuacgacacgaucaaguacuacuccaucaucccccacagcauccgcuccauccagagcgaccggaaggccugggccgccuucuacguguacaagcuccagccccugaccuuccugcucgacuucuccguggacggguacauccgccgggcgaucgacugcggcuucaacgaccugagccagcugcacugcuccuacgagagcuucgacgucgaguccggcguguacagcguguccagcuucgaggccaagcccuccgggagcgucguggagcaggccgagggcguggagugcgacuucuccccgcuccugagcgggaccccgccccaggucuacaacuucaagcgccugguguucaccaacugcaacuacaaccucacgaagcugcugucccucuucagcgucaacgacuucacgugcucccagaucagccccgccgccaucgcgagcaacugcuacuccagccugauccuggacuacuucuccuacccccucagcaugaaguccgaccugagcguguccagcgccgggcccaucucccaguucaacuacaagcagagcuucuccaacccgaccugccugauccucgccaccgugccccacaaccugaccaccaucaccaagccccugaaguacagcuacaucaacaagugcucccggcuccugagcgacgaccgcaccgaggucccccagcuggugaacgccaaccaguacucccccugcgugagcaucguccccuccacggugugggaggacggggacuacuaccggaagcagcucagcccgcuggagggcggcggguggcugguggccagcggcuccaccgucgcgaugaccgagcagcuccagaugggguucggcaucaccgugcaguacgggaccgacacgaacagcgugugccccaagcuggaguucgccaacgacaccaagaucgccucccagcugggcaacugcgucgaguacagccucuacggcguguccgggcgcggcguguuccagaacugcaccgccgucggggugcggcagcagcgcuucguguacgacgcguaccagaaccuggucggcuacuacagcgacgacggcaacuacuacugccugcgggccugcguguccgugcccgucagcgugaucuacgacaaggagaccaagacgcacgccacccuguucggguccguggccugcgagcacaucagcuccaccaugagccaguacucccgcagcacccgcuccaugcucaagcggcgcgacagcacguacggcccgcugcagacccccgucgggugcgugcugggccucgugaacuccagccuguucgucgaggacugcaagcugccccucgggcagucccugugcgcccugcccgacaccccgagcacccucacgccccggagcgugcgcuccgugcccggcgagaugcggcuggcgagcaucgccuucaaccaccccauccaggucgaccagcugaacuccagcuacuucaagcucuccaucccgaccaacuucagcuucggcgugacccaggaguacauccagaccacgauccagaaggugaccgucgacugcaagcaguacgugugcaacggguuccagaagugcgagcagcugcugcgcgaguacggccaguucugcuccaagaucaaccaggcccuccacggggccaaccugcggcaggacgacagcgugcgcaaccuguucgccuccgucaagagcucccagagcucccccaucauccccggcuucgggggcgacuucaaccucacccugcuggagcccgugagcaucuccaccggcagccgguccgcgcgcagcgccaucgaggaccuccuguucgacaaggugacgaucgccgacccgggguacaugcagggcuacgacgacugcaugcagcaggggcccgccuccgcccgggaccugaucugcgcgcaguacgucgccggcuacaaggugcucccgccccugauggacgugaacauggaggccgccuacaccagcagccugcucggguccaucgcgggcgucggcuggaccgccgggcugagcuccuucgccgccauccccuucgcccagagcaucuucuaccgccugaacggcguggggaucacccagcagguccucuccgagaaccagaagcugaucgcgaacaaguucaaccaggcccugggcgccaugcagacgggguucaccaccaccaacgaggccuuccacaaggugcaggacgccgugaacaacaacgcgcaggcccucagcaagcuggccuccgagcugagcaacacguucggcgccaucuccgccagcaucggcgacaucauccagcggcucgacgugcuggagcaggacgcgcagaucgaccgccugaucaacgggcggcucaccacccugaacgccuucgucgcccagcagcuggugcgcuccgagagcgccgcgcucuccgcccagcuggccaaggacaaggugaacgagugcgucaaggcccagagcaagcgguccggcuucugcgggcagggcacccacaucgugagcuucgucgugaacgcccccaacggccuguacuucaugcacgugggguacuaccccuccaaccacaucgaggucgugagcgcguacggccucugcgacgccgccaaccccacgaacugcaucgccccggugaacggguacuucaucaagaccaacaacacccgcaucgucgacgagugguccuacaccggcagcagcuucuacgcccccgagcccaucacgucccugaacaccaaguacguggcgccccaggugaccuaccagaacaucagcaccaaccugccgccgccccuccuggggaacuccaccggcaucgacuuccaggacgagcuggacgaguucuucaagaacgucagcacguccauccccaacuucggcagccucacccagaucaacaccacccugcuggaccucacguacgagaugcugucccugcagcaggucgugaaggcccucaacgagagcuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccggugcugcgaccgcuacgaggaguacgaccucgagccccacaaggugcacguccacuga

SEQ ID NO: 320 - RNA, 4062 nt, Artificial Sequence
  derived and/or modified CDS sequence (opt1) from MERS-CoV__AHI48605__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccacaaggugcaggacgccgugaacaacaacgcgcaggcccucuccaagcuggccagcgagcuguccaacacguucggcgccaucagcgccuccaucggcgacaucauccagcggcucgacgugcuggagcaggacgcgcagaucgaccgccugaucaacgggcggcucaccacccugaacgccuucgucgcccagcagcuggugcgcagcgaguccgccgcgcucagcgcccagcuggccaaggacaaggugaacgagugcgucaaggcccaguccaagcggagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccgcaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccggugcugcgaccgcuacgaggaguacgaccucgagccccacaaggugcacguccacuga

SEQ ID NO: 321 - RNA, 4062 nt, Artificial Sequence
  derived and/or modified CDS sequence (opt1) from MERS-CoV__AHY21469__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccgucaccacgccccagaagcuguucguggccaacuacucccaggacgugaagcaguucgccaacggcuucgucgugcgcaucggggccgcggccaacagcaccggcaccgugaucaucucccccagcaccuccgccaccauccggaagaucuaccccgccuucaugcuggggagcuccgucggcaacuucagcgacgggaagaugggccgcuucuucaaccacacgcucgugcugcugccggacggcugcgggacccuccugcgggcguucuacugcauccuggagccccgcuccggcaacuacugccccgccgggaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucggcaucacccagaccgcgcagggggugcaccucuucagcucccgguacgucgaccuguacggcgggaacauguuccaguucgccacccugccgguguacgacacgaucaaguacuacagcaucaucccccacuccauccucagcauccaguccgaccgcaaggccugggccgccuucuacguguacaagcugcagccccugaccuuccuccuggacuucagcgucgacggcuacauccggcgcgcgaucgacugcggguucaacgaccugucccagcuccacugcagcuacgaguccuucgacguggagagcggcguguacuccgucagcuccuucgaggccaagcccagcggcuccgugguggagcaggccgagggggucgagugcgacuucagcccgcugcuguccggcaccccgccccagguguacaacuucaagcggcucgucuucaccaacugcaacuacaaccugacgaagcugcucagccuguucuccgugaacgacuucacgugcagccagaucagccccgccgccaucgcguccaacugcuacagcucccugauccucgacuacuucagcuacccccuguccaugaaguccgaccugagcgugagcuccgccgggcccaucagccaguucaacuacaagcaguccuucagcaacccgaccugccucauccuggccaccgucccccacaaccugaccaccaucaccaagccccucaaguacuccuacaucaacaagugcagccgccugcuguccgacgaccggaccgaggugccccagcucgugaacgccaaccaguacagccccugcgucuccaucgugcccagcacggugugggaggacggggacuacuaccgcaagcagcugagcccgcuggagggcgggggcuggcucgucgccuccgggagcaccguggcgaugaccgagcagcugcagaugggcuucgggaucaccgugcaguacggcaccgacacgaacuccgucugccccaagcuggaguucgccaacgacaccaagaucgccagccagcucgggaacugcguggaguacucccuguacggcgugagcggccgcggggucuuccagaacugcaccgccgugggcgugcggcagcagcgguucgucuacgacgcguaccagaaccuggugggguacuacuccgacgacggcaacuacuacugccugcgcgccugcgugagcguccccguguccgugaucuacgacaaggagaccaagacgcacgccacccucuucggcagcgucgccugcgagcacaucuccagcaccaugucccaguacagccgguccacccgcagcaugcugaagcgccgggacuccacguacgggccgcugcagacccccgugggcugcgugcucgggcuggucaacagcucccuguucguggaggacugcaagcucccccugggccagagccugugcgcccuccccgacaccccgagcacccugacgccccgcuccgugcggagcguccccggggagaugcgccuggcguccaucgccuucaaccaccccauccagguggaccagcucaacagcuccuacuucaagcugagcaucccgaccaacuucuccuucggcgugacccaggaguacauccagaccacgauccagaaggucaccguggacugcaagcaguacgugugcaacggcuuccagaagugcgagcagcugcuccgggaguacgggcaguucugcagcaagaucaaccaggcccugcacggcgccaaccugcgccaggacgacuccguccggaaccucuucgccagcgugaaguccagccaguccagccccaucauccccggguucggcggggacuucaaccugacccugcucgagcccguguccaccagcacgggcucccgcagcgcgcgguccgccaucgaggaccugcuguucgacaaggucaccaucgccgacccgggcuacaugcagggguacgacgacugcaugcagcagggccccgccagcgcccgcgaccucaucugcgcgcaguacguggccggguacaaggugcugccgccccugauggacgucaacauggaggccgccuacaccagcucccuccugggcagcaucgcgggggugggcuggaccgccggccuguccagcuucgccgccauccccuucgcccaguccaucuucuaccggcucaacggggugggcaucacgcagcagguccugagcgagaaccagaagcugaucgcgaacaaguucaaccaggcccucggggccaugcagaccggcuucaccaccacgaacgaggccuuccagaaggugcaggacgccgugaacaacaacgcgcaggcccuguccaagcuggccagcgagcucuccaacaccuucggggccaucagcgccuccaucggcgacaucauccagcgccuggacguccuggagcaggacgcgcagaucgaccggcucaucaacggccgccugaccacccugaacgccuucguggcccagcagcucgugcggagcgaguccgccgcgcugagcgcccagcuggccaaggacaaggucaacgagugcgugaaggcccaguccaagcgcagcggguucugcggccaggggacgcacaucgucuccuucguggugaacgcccccaacggccucuacuucaugcacgucggcuacuaccccagcaaccacaucgaggugguguccgcguacgggcugugcgacagcgccaaccccaccaacugcaucgccccggucaacggcuacuucaucaagaccaacaacacccggaucguggacgaguggagcuacacgggguccagcuucuacgcccccgagcccaucaccucccugaacaccaaguacguggcgccccaggucaccuaccagaacaucagcaccaaccucccgccgccccugcugggcaacuccacggggaucgacuuccaggacgagcucgacgaguucuucaagaacgugagcaccuccauccccaacuucggcagccugacccagaucaacaccacgcugcucgaccugaccuacgagaugcugucccuccagcaggucgugaaggcccugaacgagagcuacaucgaccugaaggagcucggcaacuacaccuacuacaacaaguggcccugguacaucuggcugggguucaucgccggccugguggcccucgcccugugcguguucuucauccugugcugcaccgggugcggcacgaacugcauggggaagcucaagugcaaccgcugcugcgaccgguacgaggaguacgaccuggagccccacaagguccacgugcacuga

SEQ ID NO: 322 - RNA, 4062 nt, Artificial Sequence
  derived and/or modified CDS sequence (opt1) from MERS-CoV__AHZ64057__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuucuccaccaugagccaguacucccgcagcacccgcuccaugcucaagcggcgcgacagcacguacggcccgcugcagacccccgucgggugcgugcugggccucgugaacuccagccuguucgucgaggacugcaagcugccccucgggcagucccugugcgcccugcccgacaccccgagcacccucacgccccggagcgugcgcuccgugcccggcgagaugcggcuggcgagcaucgccuucaaccaccccauccaggucgaccagcugaacuccagcuacuucaagcucuccaucccgaccaacuucagcuucggcgugacccaggaguacauccagaccacgauccagaaggugaccgucgacugcaagcaguacgugugcaacggguuccagaagugcgagcagcugcugcgcgaguacggccaguucugcuccaagaucaaccgggcccuccacggggccaaccugcgccaggacgacagcgugcggaaccuguucgccuccgucaagagcucccagagcucccccaucauccccggcuucgggggcgacuucaaccucacccugcuggagcccgugagcaucuccaccggcagccgcuccgcgcggagcgccaucgaggaccuccuguucgacaaggugacgaucgccgacccgggguacaugcagggcuacgacgacugcaugcagcaggggcccgccuccgcccgcgaccugaucugcgcgcaguacgucgccggcuacaaggugcucccgccccugauggacgugaacauggaggccgccuacaccagcagccugcucggguccaucgcgggcgucggcuggaccgccgggcugagcuccuucgccgccauccccuucgcccagagcaucuucuaccggcugaacggcguggggaucacccagcagguccucuccgagaaccagaagcugaucgcgaacaaguucaaccaggcccugggcgccaugcagacgggguucaccaccaccaacgaggccuuccgcaaggugcaggacgccgugaacaacaacgcgcaggcccucagcaagcuggccuccgagcugagcaacacguucggcgccaucuccgccagcaucggcgacaucauccagcggcucgacgugcuggagcaggacgcgcagaucgaccgccugaucaacgggcggcucaccacccugaacgccuucgucgcccagcagcuggugcgcuccgagagcgccgcgcucuccgcccagcuggccaaggacaaggugaacgagugcgucaaggcccagagcaagcgguccggcuucugcgggcagggcacccacaucgugagcuucgucgugaacgcccccaacggccuguacuucaugcacgugggguacuaccccuccaaccacaucgaggucgugagcgcguacggccucugcgacgccgccaaccccacgaacugcaucgccccggugaacggguacuucaucaagaccaacaacacccgcaucgucgacgagugguccuacaccggcagcagcuucuacgcccccgagcccaucacgucccugaacaccaaguacguggcgccccaggugaccuaccagaacaucagcaccaaccugccgccgccccuccuggggaacuccaccggcaucgacuuccaggacgagcuggacgaguucuucaagaacgucagcacguccauccccaacuucggcagccucacccagaucaacaccacccugcuggaccucacguacgagaugcugucccugcagcaggucgugaaggcccucaacgagagcuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgguacgaggaguacgaccucgagccccacaaggugcacguccacuga

SEQ ID NO: 323 - RNA, 4062 nt, Artificial Sequence
  derived and/or modified CDS sequence (opt1) from MERS-CoV__AID50418__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccagcgccucgacgugcuggagcaggacgcgcagaucgaccggcugaucaacgggcgccucaccacccugaacgccuucgucgcccagcagcuggugcggagcgaguccgccgcgcucagcgcccagcuggccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccggaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 324 - RNA, 4062 nt, Artificial Sequence
  derived and/or modified CDS sequence (opt1) from MERS-CoV__AID55068__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccgggcccuccacggggccaaccugcgccaggacgacuccgugcggaaccuguucgccagcgucaaguccagccaguccagccccaucauccccggcuucgggggcgacuucaaccucacccugcuggagcccguguccaucagcaccggcucccgcagcgcgcgguccgccaucgaggaccuccuguucgacaaggugacgaucgccgacccgggguacaugcagggcuacgacgacugcaugcagcaggggcccgccagcgcccgcgaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccggcugaacggcguggggaucacccagcagguccucagcgagaaccagaagcugaucgcgaacaaguucaaccaggcccugggcgccaugcagacgggguucaccaccaccaacgaggccuuccgcaaggugcaggacgccgugaacaacaacgcgcaggcccucuccaagcuggccagcgagcuguccaacacguucggcgccaucagcgccuccaucggcgacaucauccagcggcucgacgugcuggagcaggacgcgcagaucgaccgccugaucaacgggcggcucaccacccugaacgccuucgucgcccagcagcuggugcgcagcgaguccgccgcgcucagcgcccagcuggccaaggacaaggugaacgagugcgucaaggcccaguccaagcggagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccgcaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgguacgaggaguacgaccucgagccccacaaggugcacguccacuga

SEQ ID NO: 325 - RNA, 4062 nt, Artificial Sequence
  derived and/or modified CDS sequence (opt1) from MERS-CoV__AID55073__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaacuucacgaagcuccugagccuguucuccgucaacgacuucacgugcagccagaucagccccgccgccaucgcguccaacugcuacagcucccucauccuggacuacuucagcuacccccuguccaugaaguccgaccucagcgugagcuccgccgggcccaucagccaguucaacuacaagcaguccuucagcaacccgaccugccugauccuggccaccgugccccacaaccucaccaccaucaccaagccccugaaguacuccuacaucaacaagugcagccggcugcucuccgacgaccgcaccgaggucccccagcuggugaacgccaaccaguacagccccugcguguccaucguccccagcacggugugggaggacggggacuacuaccggaagcagcugagcccgcucgagggcggcggguggcugguggccuccggcagcaccgucgcgaugaccgagcagcugcagaugggguucggcaucaccgugcaguacgggaccgacacgaacuccgugugccccaagcucgaguucgccaacgacaccaagaucgccagccagcugggcaacugcgucgaguacucccuguacggcgugagcgggcgcggcguguuccagaacugcaccgccgucggggugcggcagcagcgcuucguguacgacgcguaccagaaccucgucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcugaagcggcgcgacuccacguacggcccgcuccagacccccgucgggugcgugcugggccuggugaacagcucccucuucgucgaggacugcaagcugccccuggggcagagccucugcgcccugcccgacaccccgagcacccugacgccccgguccgugcgcagcgugcccggcgagaugcggcucgcguccaucgccuucaaccaccccauccaggucgaccagcugaacagcuccuacuucaagcugagcaucccgaccaacuucuccuucggcgugacccaggaguacauccagaccacgauccagaaggugaccgucgacugcaagcaguacgugugcaacggguuccagaagugcgagcagcuccugcgcgaguacggccaguucugcagcaagaucaaccaggcccugcacggggccaaccuccggcaggacgacuccgugcgcaaccuguucgccagcgucaaguccagccaguccagccccaucauccccggcuucgggggcgacuucaaccugacccuccuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcugccgccccucauggacgugaacauggaggccgccuacaccagcucccugcuggggagcaucgcgggcgucggcuggaccgccgggcucuccagcuucgccgccauccccuucgcccaguccaucuucuaccgccugaacggcguggggaucacccagcagguccugagcgagaaccagaagcucaucgcgaacaaguucaaccaggcccugggcgccaugcagacgggguucaccaccaccaacgaggccuuccggaaggugcaggacgccgugaacaacaacgcgcaggcccuguccaagcucgccagcgagcuguccaacacguucggcgccaucagcgccuccaucggcgacaucauccagcgccuggacgugcucgagcaggacgcgcagaucgaccggcugaucaacgggcgccugaccacccucaacgccuucgucgcccagcagcuggugcggagcgaguccgccgcgcugagcgcccagcucgccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccugugcgacgccgccaaccccacgaacugcaucgccccggugaacggguacuucaucaagaccaacaacacccggaucgucgacgaguggagcuacaccggcagcuccuucuacgcccccgagcccaucacgagccucaacaccaaguacguggcgccccaggugaccuaccagaacaucuccaccaaccugccgccgccccugcucgggaacagcaccggcaucgacuuccaggacgagcuggacgaguucuucaagaacgucuccacgagcauccccaacuucggcucccugacccagaucaacaccacccuccuggaccugacguacgagaugcucagccugcagcaggucgugaaggcccugaacgaguccuacaucgaccucaaggagcuggggaacuacaccuacuacaacaaguggcccugguacaucuggcugggcuucaucgccgggcucguggcccuggcccugugcguguucuucauccucugcugcaccggcugcgggaccaacugcaugggcaagcugaagugcaaccgcugcugcgaccgcuacgaggaguacgaccuggagccccacaaggugcacguccacuga

SEQ ID NO: 326 - RNA, 4062 nt, Artificial Sequence
  derived and/or modified CDS sequence (opt1) from MERS-CoV__AIY60528__S
augauccacagcguguuccugcucauguuccugcugacccccaccgaguccuacgucgacgugggcccggacagcuucaaguccgccugcaucgagguggacauccagcagacguucuucgacaagaccuggccccgccccaucgacgucagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucguggccaacuacucccagaacgucaagcaguucgccaacggguucguggugcgcaucggcgccgcggccaacagcaccgggaccgucaucaucucccccagcaccuccgccaccauccggaagaucuaccccgccuucaugcugggcagcuccguggggaacuucagcgacggcaagaugggccgcuucuucaaccacacgcucgugcugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcguccaccucuucagcucccgguacguggaccuguacgggggcaacauguuccaguucgccacccugccgguguacgacacgaucaaguacuacagcaucaucccccacuccauccgcagcauccaguccgaccggaaggccugggccgccuucuacgucuacaagcuccagccccugaccuuccugcucgacuucagcguggacggguacauccgccgggcgaucgacugcggcuucaacgaccugucccagcugcacugcagcuacgaguccuucgacguggagagcggcgucuacuccgugagcuccuucgaggccaagcccagcggguccguggucgagcaggccgagggcguggagugcgacuucagcccgcuccuguccgggaccccgccccagguguacaacuucaagcgccuggucuucaccaacugcaacuacaaccucacgaagcugcugagccucuucuccgugaacgacuucacgugcagccagaucagccccgccgccaucgcguccaacugcuacagcucccugauccuggacuacuucagcuacccccucuccaugaaguccgaccugagcgucagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggugccccagcuggucaacgccaaccaguacagccccugcguguccaucgugcccagcacggucugggaggacggggacuacuaccggaagcagcucagcccgcuggagggcggcggguggcugguggccuccggcagcaccguggcgaugaccgagcagcuccagaugggguucggcaucaccguccaguacgggaccgacacgaacuccgugugccccaagcuggaguucgccaacgacaccaagaucgccagccagcugggcaacugcguggaguacucccucuacggcgucagcgggcgcggcguguuccagaacugcaccgccguggggguccggcagcagcgcuucguguacgacgcguaccagaaccuggugggcuacuacuccgacgacggcaacuacuacugccugcgggccugcgucagcgugcccguguccgucaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccguggggugcguccugggccucgugaacagcucccuguucguggaggacugcaagcugccccucgggcagagccugugcgcccugcccgacaccccgagcacccucacgccccgguccguccgcagcgugcccggcgagaugcggcuggcguccaucgccuucaaccaccccauccagguggaccagcugaacagcuccuacuucaagcucagcaucccgaccaacuucuccuucggcgucacccaggaguacauccagaccacgauccagaaggugaccguggacugcaagcaguacgucugcaacggguuccagaagugcgagcagcugcugcgcgaguacggccaguucugcagcaagaucaaccaggcccuccacggggccaaccugcggcaggacgacuccgugcgcaaccuguucgccagcgugaaguccagccaguccagccccaucauccccggcuucgggggcgacuucaaccucacccugcuggagcccgucuccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacguggccggcuacaagguccucccgccccugauggacgugaacauggaggccgccuacaccagcucccugcucgggagcaucgcgggcgugggcuggaccgccgggcuguccagcuucgccgccauccccuucgcccaguccaucuucuaccgccugaacggcgucgggaucacccagcagguccucagcgagaaccagaagcugaucgcgaacaaguucaaccaggcccugggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccagcgccucgacgugcuggagcaggacgcgcagaucgaccggcugaucaacgggcgccucaccacccugaacgccuucguggcccagcagcugguccggagcgaguccgccgcgcucagcgcccagcuggccaaggacaaggugaacgagugcgugaaggcccaguccaagcgcagcggcuucugcgggcagggcacccacaucgucuccuucguggucaacgcccccaacggccuguacuucaugcacgugggguacuaccccagcaaccacaucgagguggucuccgcguacggccucugcgacgccgccaaccccacgaacugcaucgccccggugaacggguacuucaucaagaccaacaacacccggaucguggacgaguggagcuacaccggcagcuccuucuacagccccgagcccaucacgucccugaacaccaaguacgucgcgccccaggugaccuaccagaacaucagcaccaaccugccgccgccccuccuggggaacuccaccggcaucgacuuccaggacgagcuggacgaguucuucaagaacgugagcacguccauccccaacuucggcagccucacccagaucaacaccacccugcuggaccucacguacgagaugcugucccugcagcaggucgugaaggcccucaacgagagcuacaucgaccugaaggagcuggggaacuacaccuacuacaacaaguggcccugguacaucuggcucggcuucaucgccgggcugguggcccuggcccucugcgucuucuucauccugugcugcaccggcugcgggaccaacugcaugggcaagcugaagugcaaccgcugcugcgaccgcuacgaggaguacgaccucgagccccacaaggugcacgugcacuga

SEQ ID NO: 327 - RNA, 4062 nt, Artificial Sequence
  derived and/or modified CDS sequence (opt1) from MERS-CoV__AIY60558__S
augauccacagcguguuccugcucauguuccugcugacccccaccgaguccuacgucgacgugggcccggacagcuucaaguccgccugcaucgagguggacauccagcagacguucuucgacaagaccuggccccgccccaucgacgucagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucguggccaacuacucccaggacgucaagcaguucgccaacggguucguggugcgcaucggcgccgcggccaacagcaccgggaccgucaucaucucccccagcaccuccgccaccauccggaagaucuaccccgccuucaugcugggcagcuccguggggaacuucagcgacggcaagaugggccgcuucuucaaccacacgcucgugcugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcguccaccucuucagcucccgguacguggaccuguacgggggcaacauguuccaguucgccacccugccgguguacgacacgaucaaguacuacagcaucaucccccacuccauccgcagcauccaguccgaccggaaggccugggccgccuucuacgucuacaagcuccagccccugaccuuccugcucgacuucagcguggacggguacauccgccgggcgaucgacugcggcuucaacgaccugucccagcugcacugcagcuacgaguccuucgacguggagagcggcgucuacuccgugagcuccuucgaggccaagcccagcggguccguggucgagcaggccgagggcguggagugcgacuucagcccgcuccuguccgggaccccgccccagguguacaacuucaagcgccuggucuucaccaacugcaacuacaaccucacgaagcugcugagccucuucuccgugaacgacuucacgugcagccagaucagccccgccgccaucgcguccaacugcuacagcucccugauccuggacuacuucagcuacccccucuccaugaaguccgaccugagcgucagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggugccccagcuggucaacgccaaccaguacagccccugcguguccaucgugcccagcacggucugggaggacggggacuacuaccggaagcagcucagcccgcuggagggcggcggguggcugguggccuccggcagcaccguggcgaugaccgagcagcuccagaugggguucggcaucaccguccaguacgggaccgacacgaacuccgugugccccaagcuggaguucgccaacgacaccaagaucgccagccagcugggcaacugcguggaguacucccucuacggcgucagcgggcgcggcguguuccagaacugcaccgccguggggguccggcagcagcgcuucguguacgacgcguaccagaaccuggugggcuacuacuccgacgacggcaacuacuacugccugcgggccugcgucagcgugcccguguccgucaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccguggggugcguccugggccucgugaacagcucccuguucguggaggacugcaagcugccccucgggcagagccugugcgcccugcccgacaccccgagcacccucacgccccgguccguccgcagcgugcccggcgagaugcggcuggcguccaucgccuucaaccaccccauccagguggaccagcugaacagcuccuacuucaagcucagcaucccgaccaacuucuccuucggcgucacccaggaguacauccagaccacgauccagaaggugaccguggacugcaagcaguacgucugcaacggguuccagaagugcgagcagcugcugcgcgaguacggccaguucugcagcaagaucaaccaggcccuccacggggccaaccugcggcaggacgacuccgugcgcaaccuguucgccagcgugaaguccagccaguccagccccaucauccccggcuucgggggcgacuucaaccucacccugcuggagcccgucuccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacguggccggcuacaagguccucccgccccugauggacgugaacauggaggccgccuacaccagcucccugcucgggagcaucgcgggcgugggcuggaccgccgggcuguccagcuucgccgccauccccuucgcccaguccaucuucuaccgccugaacggcgucgggaucacccagcagguccucagcgagaaccagaagcugaucgcgaacaaguucaaccaggcccugggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccagcgccucgacgugcuggagcaggacgcgcagaucgaccggcugaucaacgggcgccucaccacccugaacgccuucguggcccagcagcugguccggagcgaguccgccgcgcucagcgcccagcuggccaaggacaaggugaacgagugcgugaaggcccaguccaagcgcagcggcuucugcgggcagggcacccacaucgucuccuucguggucaacgcccccaacggccuguacuucaugcacgugggguacuaccccagcaaccacaucgagguggucuccgcguacggccucugcgacgccgccaaccccacgaacugcaucgccccggugaacggguacuucaucaagaccaacaacacccggaucguggacgaguggagcuacaccggcagcuccuucuacagccccgagcccaucacgucccugaacaccaaguacgucgcgccccaggugaccuaccagaacaucagcaccaaccugccgccgccccuccuggggaacuccaccggcaucgacuuccaggacgagcuggacgaguucuucaagaacgugagcacguccauccccaacuucggcagccucacccagaucaacaccacccugcuggaccucacguacgagaugcugucccugcagcaggucgugaaggcccucaacgagagcuacaucgaccugaaggagcuggggaacuacaccuacuacaacaaguggcccugguacaucuggcucggcuucaucgccgggcugguggcccuggcccucugcgucuucuucauccugugcugcaccggcugcgggaccaacugcaugggcaagcugaagugcaaccgcugcugcgaccgcuacgaggaguacgaccucgagccccacaaggugcacgugcacuga

SEQ ID NO: 328 - RNA, 4062 nt, Artificial Sequence
  derived and/or modified CDS sequence (opt1) from MERS-CoV__AIZ74450__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcaccaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccagcgccucgacgugcuggagcaggacgcgcagaucgaccggcugaucaacgggcgccucaccacccugaacgccuucgucgcccagcagcuggugcggagcgaguccgccgcgcucagcgcccagcuggccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccggaucgucgacgaguggagcuacaccggcagcuccuucuacagccccgagcccaucacgucccugaacaccaaguacguggcgccccaggugaccuaccagaacaucagcaccaaccugccgccgccccuccuggggaacuccaccggcaucgacuuccaggacgagcuggacgaguucuucaagaacgucagcacguccauccccaacuucggcagccucacccagaucaacaccacccugcuggaccucacguacgagaugcugucccugcagcaggucgugaaggcccucaacgagagcuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 329 - RNA, 4062 nt, Artificial Sequence
  derived and/or modified CDS sequence (opt1) from MERS-CoV__AJD81440__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucaaccccuccaccagcgccaccauccggaagaucuaccccgccuucaugcugggcuccagcguggggaacuucuccgacggcaagaugggccgcuucuucaaccacacgcucguccugcugccggacgggugcggcacccuccugcgggcguucuacugcauccuggagccccgcagcgggaaccacugccccgccggcaacuccuacaccagcuucgccaccuaccacacgcccgccaccgacugcuccgacggcaacuacaaccggaacgccagccucaacuccuucaaggaguacuucaaccugcgcaacugcaccuucauguacaccuacaacaucacggaggacgagauccuggagugguucgggaucacccagaccgcgcagggcgugcaccucuucagcagccgguacguggaccuguacgggggcaacauguuccaguucgccacccugccggucuacgacacgaucaaguacuacuccaucaucccccacagcauccgcuccauccagagcgaccggaaggccugggccgccuucuacguguacaagcuccagccccugaccuuccugcucgacuucuccguggacggguacauccgccgggcgaucgacugcggcuucaacgaccugagccagcugcacugcuccuacgagagcuucgacgucgaguccggcguguacagcguguccagcuucgaggccaagcccuccgggagcgucguggagcaggccgagggcguggagugcgacuucuccccgcuccugagcgggaccccgccccaggucuacaacuucaagcgccugguguucaccaacugcaacuacaaccucacgaagcugcugucccucuucagcgucaacgacuucacgugcucccagaucagccccgccgccaucgcgagcaacugcuacuccagccugauccuggacuacuucuccuacccccucagcaugaaguccgaccugagcguguccagcgccgggcccaucucccaguucaacuacaagcagagcuucuccaacccgaccugccugauccucgccaccgugccccacaaccugaccaccaucaccaagccccugaaguacagcuacaucaacaagugcucccggcuccugagcgacgaccgcaccgaggucccccagcuggugaacgccaaccaguacucccccugcgugagcaucguccccuccacggugugggaggacggggacuacuaccggaagcagcucagcccgcuggagggcggcggguggcugguggccagcggcuccaccgucgcgaugaccgagcagcuccagaugggguucggcaucaccgugcaguacgggaccgacacgaacagcgugugccccaagcuggaguucgccaacgacaccaagaucgccucccagcugggcaacugcgucgaguacagccucuacggcguguccgggcgcggcguguuccagaacugcaccgccgucggggugcggcagcagcgcuucguguacgacgcguaccagaaccuggucggcuacuacagcgacgacggcaacuacuacugccugcgggccugcguguccgugcccgucagcgugaucuacgacaaggagaccaagacgcacgccacccuguucggguccguggccugcgagcacaucagcuccaccaugagccaguacucccgcagcacccgcuccaugcucaagcggcgcgacagcacguacggcccgcugcagacccccgucgggugcgugcugggccucgugaacuccagccuguucgucgaggacugcaagcugccccucgggcagucccugugcgcccugcccgacaccccgagcacccucacgccccggagcgugcgcuccgugcccggcgagaugcggcuggcgagcaucgccuucaaccaccccauccaggucgaccagcugaacuccagcuacuucaagcucuccaucccgaccaacuucagcuucggcgugacccaggaguacauccagaccacgauccagaaggugaccgucgacugcaagcaguacgugugcaacggguuccagaagugcgagcagcugcugcgcgaguacggccaguucugcuccaagaucaaccaggcccuccacggggccaaccugcggcaggacgacagcgugcgcaaccuguucgccuccgucaagagcucccagagcucccccaucauccccggcuucgggggcgacuucaaccucacccugcuggagcccgugagcaucuccaccggcagccgguccgcgcgcagcgccaucgaggaccuccuguucgacaaggugacgaucgccgacccgggguacaugcagggcuacgacgacugcaugcagcaggggcccgccuccgcccgggaccugaucugcgcgcaguacgucgccggcuacaaggugcucccgccccugauggacgugaacauggaggccgccuacaccagcagccugcucggguccaucgcgggcgucggcuggaccgccgggcugagcuccuucgccgccauccccuucgcccagagcaucuucuaccgccugaacggcguggggaucacccagcagguccucuccgagaaccagaagcugaucgcgaacaaguucaaccaggcccugggcgccaugcagacgggguucaccaccaccaacgaggccuuccggaaggugcaggacgccgugaacaacaacgcgcaggcccucagcaagcuggccuccgagcugagcaacacguucggcgccaucuccgccagcaucggcgacaucauccagcgccucgacgugcuggagcaggacgcgcagaucgaccggcugaucaacgggcgccucaccacccugaacgccuucgucgcccagcagcuggugcgguccgagagcgccgcgcucuccgcccagcuggccaaggacaaggugaacgagugcgucaaggcccagagcaagcgcuccggcuucugcgggcagggcacccacaucgugagcuucgucgugaacgcccccaacggccuguacuucaugcacgugggguacuaccccuccaaccacaucgaggucgugagcgcguacggccucugcgacgccgccaaccccacgaacugcaucgccccggugaacggguacuucaucaagaccaacaacacccggaucgucgacgagugguccuacaccggcagcagcuucuacgcccccgagcccaucacgucccugaacaccaaguacguggcgccccaggugaccuaccagaacaucagcaccaaccugccgccgccccuccuggggaacuccaccggcaucgacuuccaggacgagcuggacgaguucuucaagaacgucagcacguccauccccaacuucggcagccucacccagaucaacaccacccugcuggaccucacguacgagaugcugucccugcagcaggucgugaaggcccucaacgagagcuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 330 - RNA, 4062 nt, Artificial Sequence
  derived and/or modified CDS sequence (opt1) from MERS-CoV__AKI29284__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccagcgccucgacgugcuggagcaggacgcgcagaucgaccggcugaucaacgggcgccucaccacccugaacgccuucgucgcccagcagcuggugcggagcgaguccgccgcgcucagcgcccagcuggccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccggaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcgcguucuucauccugugcugcaccggcugcgggaccaacugcaugggcaagcugaagugcaaccgcugcugcgaccgcuacgaggaguacgaccucgagccccacaaggugcacgugcacuga

SEQ ID NO: 331 - RNA, 4062 nt, Artificial Sequence
  derived and/or modified CDS sequence (opt1) from MERS-CoV__AKL59401__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggggaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcacccgggccaccauccgcaagaucuaccccgccuucaugcugggcuccagcguggggaacuucuccgacggcaagaugggccgguucuucaaccacacgcucguccugcugccggacgggugcggcacccuccugcgcgcguucuacugcauccuggagccccggagcgggaaccacugccccgccggcaacuccuacaccagcuucgccaccuaccacacgcccgccaccgacugcuccgacggcaacuacaaccgcaacgccagccucaacuccuucaaggaguacuucaaccugcggaacugcaccuucauguacaccuacaacaucacggaggacgagauccuggagugguucgggaucacccagaccgcgcagggcgugcaccucuucagcagccgcuacguggaccuguacgggggcaacauguuccaguucgccacccugccggucuacgacacgaucaaguacuacuccaucaucccccacagcauccgguccauccagagcgaccgcaaggccugggccgccuucuacguguacaagcuccagccccugaccuuccugcucgacuucuccguggacggguacauccggcgcgcgaucgacugcggcuucaacgaccugagccagcugcacugcuccuacgagagcuucgacgucgaguccggcguguacagcguguccagcuucgaggccaagcccuccgggagcgucguggagcaggccgagggcguggagugcgacuucuccccgcuccugagcgggaccccgccccaggucuacaacuucaagcggcugguguucaccaacugcaacuacaaccucacgaagcugcugucccucuucagcgucaacgacuucacgugcucccagaucagccccgccgccaucgcgagcaacugcuacuccagccugauccuggacuacuucuccuacccccucagcaugaaguccgaccugagcguguccagcgccggccccaucucccaguucaacuacaagcagagcuucuccaacccgaccugccugauccucgccaccgugccccacaaccugaccaccaucaccaagccccugaaguacagcuacaucaacaagugcucccgccuccugagcgacgaccggaccgaggucccccagcuggugaacgccaaccaguacucccccugcgugagcauccuccccuccacggucugggaggacggggacuacuaccgcaagcagcugagcccgcuggagggcggcggguggcucguggccagcggcuccaccguggcgaugaccgagcagcugcagaugggguucggcaucaccguccaguacgggaccgacacgaacagcgugugccccaagcuggaguucgccaacgacaccaagaucgccucccagcucggcaacugcguggaguacagccuguacggcgucuccgggcggggcguguuccagaacugcaccgccguggggguccgccagcagcgguucguguacgacgcguaccagaaccuggugggcuacuacagcgacgacggcaacuacuacugccugcgcgccugcgucuccgugcccgugagcgucaucuacgacaaggagaccaagacgcacgccacccucuucggguccguggccugcgagcacaucagcuccaccaugagccaguacucccgcagcacccgguccaugcugaagcgccgggacagcacguacggcccgcugcagacccccguggggugcguccucggccuggugaacuccagccuguucguggaggacugcaagcucccccuggggcagucccugugcgcccuccccgacaccccgagcacccugacgccccgcagcguccgguccgugcccggcgagaugcgccuggcgagcaucgccuucaaccaccccauccagguggaccagcucaacuccagcuacuucaagcuguccaucccgaccaacuucagcuucggcgucacccaggaguacauccagaccacgauccagaaggugaccguggacugcaagcaguacgucugcaacggguuccagaagugcgagcagcugcuccgggaguacggccaguucugcuccaagaucaaccaggcccugcacggggccaaccugcgccaggacgacagcgugcggaaccucuucgccuccgucaagagcucccagagcucccccaucauccccggcuucgggggcgacuucaaccugacccugcucgagcccgugagcaucuccaccggcagccgcuccgcgcggagcgccaucgaggaccugcuguucgacaaggugacgaucgccgacccgggguacaugcagggcuacgacgacugcaugcagcaggggcccgccuccgcccgcgaccucaucugcgcgcaguacguggccggcuacaagguccugccgccccugauggacgugaacauggaggccgccuacaccagcagccuccugggguccaucgcgggcgugggcuggaccgccgggcugagcuccuucgccgccauccccuucgcccagagcaucuucuaccggcucaacggcgucgggaucacccagcagguccuguccgagaaccagaagcugaucgcgaacaaguucaaccaggcccucggcgccaugcagacgggguucaccaccaccaacgaggccuuccgcaaggugcaggacgccgugaacaacaacgcgcaggcccugagcaagcuggccuccgagcucagcaacacguucggcgccaucuccgccagcaucggcgacaucauccagcggcuggacgugcuggagcaggacgcgcagaucgaccgccucaucaacgggcggcugaccacccugaacgccuucguggcccagcagcucguccgcuccgagagcgccgcgcuguccgcccagcuggccaaggacaaggugaacgagugcgugaaggcccagagcaagcgguccggcuucugcgggcagggcacccacaucgucagcuucguggucaacgcccccaacggccucuacuucaugcacgugggguacuaccccuccaaccacaucgagguggucagcgcguacggccugugcgacgccgccaaccccacgaacugcaucgccccggugaacggguacuucaucaagaccaacaacacccgcaucguggacgagugguccuacaccggcagcagcuucuacgcccccgagcccaucacgucccugaacaccaaguacgucgcgccccaggugaccuaccagaacaucagcaccaaccucccgccgccccugcuggggaacuccaccggcaucgacuuccaggacgagcucgacgaguucuucaagaacgugagcacguccauccccaacuucggcagccugacccagaucaacaccacccugcucgaccugacguacgagaugcugucccuccagcaggucgugaaggcccugaacgagagcuacaucgaccugaaggagcucgggaacuacaccuacuacaacaaguggcccugguacaucuggcugggcuucaucgccgggcugguggcccucgcccugugcgucuucuucauccugugcugcaccggcugcgggaccaacugcaugggcaagcucaagugcaaccgcugcugcgaccgguacgaggaguacgaccuggagccccacaaggugcacgugcacuga

SEQ ID NO: 332 - RNA, 4062 nt, Artificial Sequence
  derived and/or modified CDS sequence (opt1) from MERS-CoV__AKM76229__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccgcugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcccccucacgccccgguccgugcgcagcgugcccggcgagaugcggcuggcguccaucgccuucaaccacccgauccaggucgaccagcugaacagcuccuacuucaagcucagcauccccaccaacuucuccuucggcgugacccaggaguacauccagaccaccauccagaaggugacggucgacugcaagcaguacaucugcaacggguuccagaagugcgagcagcugcugcgcgaguacggccaguucugcagcaagaucaaccaggcccuccacggggccaaccugcggcaggacgacuccgugcgcaaccuguucgccagcgugaaguccagccaguccagccccaucauccccggcuucgggggcgacuucaaccucacccugcuggagccggucuccaucagcaccggcucccggagcgcgcgcuccgccaucgaggaccuccuguucgacaaggugaccaucgccgaccccggguacaugcagggcuacgacgacugcaugcagcaggggcccgccagcgcccgggaccugaucugcgcgcaguacguggccggcuacaagguccugcccccgcucauggacgugaacauggaggccgccuacacgagcucccugcucgggagcaucgcgggcgugggcuggaccgccgggcuguccagcuucgccgccauccccuucgcccaguccaucuucuaccgccugaacggcgucgggaucacccagcagguccucagcgagaaccagaagcugaucgcgaacaaguucaaccaggcccugggcgccaugcagaccggguucacgaccaccaacgaggccuuccggaaggugcaggacgccgugaacaacaacgcgcaggcccucuccaagcuggccagcgagcuguccaacaccuucggcgccaucagcgccuccaucggcgacaucauccagcgccucgacgugcuggagcaggacgcgcagaucgaccggcugaucaacgggcgccucacgacccugaacgccuucguggcccagcagcugguccggagcgaguccgccgcgcucagcgcccagcuggccaaggacaaggugaacgagugcgugaaggcccaguccaagcgcagcggcuucugcgggcagggcacccacaucgucuccuucguggucaacgcccccaacggccuguacuucaugcacgugggguacuaccccagcaaccacaucgagguggucuccgcguacggccucugcgacgccgccaacccgaccaacugcaucgcccccgugaacggguacuucaucaagacgaacaacacccggaucguggacgaguggagcuacaccggcagcuccuucuacagccccgagcccaucaccucccugaacacgaaguacgucgcgccccaggugaccuaccagaacaucagcaccaaccugcccccgccccuccuggggaacuccaccggcaucgacuuccaggacgagcuggacgaguucuucaagaacgugagcaccuccauccccaacuucggcagccucacgcagaucaacaccacccugcuggaccucaccuacgagaugcugucccugcagcaggucgugaaggcccucaacgagagcuacaucgaccugaaggagcuggggaacuacacguacuacaacaaguggcccugguacaucuggcucggcuucaucgccgggcugguggcccuggcccucugcgucuucuucauccugugcugcaccggcugcgggaccaacugcaugggcaagcugaagugcaaccgcugcugcgaccgcuacgaggaguacgaccucgagccccacaaggugcacgugcacuga

SEQ ID NO: 333 - RNA, 4062 nt, Artificial Sequence
  derived and/or modified CDS sequence (opt1) from MERS-CoV__AKM76239__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgagcugccccagcucgucaacgccaaccaguacagccccugcguguccaucgugcccagcacggucugggaggacggggacuacuaccggaagcagcugagcccgcuggagggcggcggguggcucguggccuccggcagcaccguggcgaugaccgagcagcugcagaugggguucggcaucaccguccaguacgggaccgacacgaacuccgugugccccaagcuggaguucgccaacgacaccaagaucgccagccagcucggcaacugcguggaguacucccuguacggcgucagcgggcgcggcguguuccagaacugcaccgccguggggguccggcagcagcgcuucguguacgacgcguaccagaaccuggugggcuacuacuccgacgacggcaacuacuacugccugcgggccugcgucagcgugcccguguccgucaucuacgacaaggagaccaagacgcacgccacccucuucgggagcguggccugcgagcacaucuccagcaccaugucccaguacagccgcuccacccgcagcaugcugaagcggcgcgacuccacguacggcccgcugcagacccccguggggugcguccucggccuggugaacagcucccuguucguggaggacugcaagcucccccuggggcagagccugugcgcccuccccgacaccccgagcacccugacgccccgguccguccgcagcgugcccggcgagaugcggcuggcguccaucgccuucaaccaccccauccagguggaccagcucaacagcuccuacuucaagcugagcaucccgaccaacuucuccuucggcgucacccaggaguacauccagaccacgauccagaaggugaccguggacugcaagcaguacaucugcaacggguuccagaagugcgagcagcugcuccgcgaguacggccaguucugcagcaagaucaaccaggcccugcacggggccaaccugcggcaggacgacuccguccgcaaccucuucgccagcgugaaguccagccaguccagccccaucauccccggcuucgggggcgacuucaaccugacccugcucgagcccguguccaucagcaccggcucccggagcgcgcgcuccgccaucgaggaccugcuguucgacaaggucacgaucgccgacccgggguacaugcagggcuacgacgacugcaugcagcaggggcccgccagcgcccgggaccucaucugcgcgcaguacguggccggcuacaaggugcugccgccccugauggacgucaacauggaggccgccuacaccagcucccuccuggggagcaucgcgggcgugggcuggaccgccgggcuguccagcuucgccgccauccccuucgcccaguccaucuucuaccgccucaacggcguggggaucacccagcagguccugagcgagaaccagaagcugaucgcgaacaaguucaaccaggcccucggcgccaugcagacgggguucaccaccaccaacgaggccuuccggaaggugcaggacgccgugaacaacaacgcgcaggcccuguccaagcuggccagcgagcucuccaacacguucggcgccaucagcgccuccaucggcgacaucauccagcgccuggacguccuggagcaggacgcgcagaucgaccggcucaucaacgggcgccugaccacccugaacgccuucguggcccagcagcucgugcggagcgaguccgccgcgcugagcgcccagcuggccaaggacaaggucaacgagugcgugaaggcccaguccaagcgcagcggcuucugcgggcagggcacccacaucguguccuucgucgugaacgcccccaacggccucuacuucaugcacgucggguacuaccccagcaaccacaucgaggugguguccgcguacggccugugcgacgucgccaaccccacgaacugcaucgccccggugaacggguacuucaucaagaccaacaacacccggaucguggacgaguggagcuacaccggcagcuccuucuacagccccgagcccaucacgucccugaacaccaaguacgucgcgccccaggugaccuaccagaacaucagcaccaaccucccgccgccccugcuggggaacuccaccggcaucgacuuccaggacgagcucgacgaguucuucaagaacuucagcacguccauccccaacuucggcagccugacccagaucaacaccacccugcucgaccugacguacgagaugcugucccuccagcaggucgugaaggcccugaacgagagcuacaucgaccugaaggagcucgggaacuacaccuacuacaacaaguggcccugguacaucuggcugggcuucaucgccgggcugguggcccucgcccugugcguguucuucauccugugcugcaccggcugcgggaccaacugcaugggcaagcucaagugcaaccgcugcugcgaccgcuacgaggaguacgaccuggagccccacaagguccacgugcacuga

SEQ ID NO: 334 - RNA, 4062 nt, Artificial Sequence
  derived and/or modified CDS sequence (opt1) from MERS-CoV__AKN11072__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccacgguccccagcaccgugugggaggacggggacuacuaccggaagcagcucagcccgcuggagggcggcggguggcugguggccuccggcagcaccgucgcgaugaccgagcagcuccagaugggguucggcaucaccgugcaguacgggacggacaccaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagacgaagacccacgccacccuguucgggagcguggccugcgagcacaucuccagcaccaugucccaguacagccgcuccacgcgcagcaugcucaagcggcgcgacuccaccuacggcccgcugcagacccccgucgggugcgugcugggccucgugaacagcucccuguucgucgaggacugcaagcugccccucgggcagagccugugcgcccugcccgacaccccgagcacgcucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccaccauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcacgggcucccggagcgcgcgcuccgccaucgaggaccuccuguucgacaaggugaccaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacgcagcagguccucagcgagaaccagaagcugaucgcgaacaaguucaaccaggcccugggcgccaugcagaccggguucaccaccacgaacgaggccuuccggaaggugcaggacgccgugaacaacaacgcgcaggcccucuccaagcuggccagcgagcuguccaacaccuucggcgccaucagcgccuccaucggcgacaucauccagcgccucgacgugcuggagcaggacgcgcagaucgaccggcugaucaacgggcgccucaccacccugaacgccuucgucgcccagcagcuggugcggagcgaguccgccgcgcucagcgcccagcuggccaaggacaaggugaacgagugcgucaaggcccaguccaagcgcagcggcuucugcgggcagggcacgcacaucguguccuucgucgugaacgcccccaacggccuguacuucaugcacgugggguacuaccccagcaaccacaucgaggucguguccgcguacggccucugcgacgccgccaaccccaccaacugcaucgccccggugaacggguacuucaucaagaccaacaacacccggaucgucgacgaguggagcuacacgggcagcuccuucuacgcccccgagcccaucaccagccugaacaccaaguacguggcgccccaggugaccuaccagaacaucuccaccaaccugccgccgccccuccuggggaacagcacgggcaucgacuuccaggacgagcuggacgaguucuucaagaacgucuccaccagcauccccaacuucggcucccucacccagaucaacaccacgcugcuggaccucaccuacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggacgaacugcaugggcaagcugaagugcaaccgcugcugcgaccgcuacgaggaguacgaccucgagccccacaaggugcacguccacuga

SEQ ID NO: 335 - RNA, 4062 nt, Artificial Sequence
  derived and/or modified CDS sequence (opt1) from MERS-CoV__AKN11074__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccacgguccccagcaccgugugggaggacggggacuacuaccggaagcagcucagcccgcuggagggcggcggguggcugguggccuccggcagcaccgucgcgaugaccgagcagcuccagaugggguucggcaucaccgugcaguacgggacggacaccaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcacuucguguacgacgcguaccagaaccuggucggcuacuacuccgacgacggcaacuacuacugccugcgcgccugcgugagcgugcccgucuccgugaucuacgacaaggagacgaagacccacgccacccuguucgggagcguggccugcgagcacaucuccagcaccaugucccaguacagccgguccacgcgcagcaugcucaagcgccgggacuccaccuacggcccgcugcagacccccgucgggugcgugcugggccucgugaacagcucccuguucgucgaggacugcaagcugccccucgggcagagccugugcgcccugcccgacaccccgagcacgcucacgccccgcuccgugcggagcgugcccggcgagaugcgccuggcguccaucgccuucaaccaccccauccaggucgaccagcugaacagcuccuacuucaagcucagcaucccgaccaacuucuccuucggcgugacccaggaguacauccagaccaccauccagaaggugaccgucgacugcaagcaguacgugugcaacggguuccagaagugcgagcagcugcugcgggaguacggccaguucugcagcaagaucaaccaggcccuccacggggccaaccugcgccaggacgacuccgugcggaaccuguucgccagcgucaaguccagccaguccagccccaucauccccggcuucgggggcgacuucaaccucacccugcuggagcccguguccaucagcacgggcucccgcagcgcgcgguccgccaucgaggaccuccuguucgacaaggugaccaucgccgacccgggguacaugcagggcuacgacgacugcaugcagcaggggcccgccagcgcccgcgaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccggcugaacggcguggggaucacgcagcagguccucagcgagaaccagaagcugaucgcgaacaaguucaaccaggcccugggcgccaugcagaccggguucaccaccacgaacgaggccuuccgcaaggugcaggacgccgugaacaacaacgcgcaggcccucuccaagcuggccagcgagcuguccaacaccuucggcgccaucagcgccuccaucggcgacaucauccagcggcucgacgugcuggagcaggacgcgcagaucgaccgccugaucaacgggcggcucaccacccugaacgccuucgucgcccagcagcuggugcgcagcgaguccgccgcgcucagcgcccagcuggccaaggacaaggugaacgagugcgucaaggcccaguccaagcggagcggcuucugcgggcagggcacgcacaucguguccuucgucgugaacgcccccaacggccuguacuucaugcacgugggguacuaccccagcaaccacaucgaggucguguccgcguacggccucugcgacgccgccaaccccaccaacugcaucgccccggugaacggguacuucaucaagaccaacaacacccgcaucgucgacgaguggagcuacacgggcagcuccuucuacgcccccgagcccaucaccagccugaacaccaaguacguggcgccccaggugaccuaccagaacaucuccaccaaccugccgccgccccuccuggggaacagcacgggcaucgacuuccaggacgagcuggacgaguucuucaagaacgucuccaccagcauccccaacuucggcucccucacccagaucaacaccacgcugcuggaccucaccuacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggacgaacugcaugggcaagcugaagugcaaccggugcugcgaccgcuacgaggaguacgaccucgagccccacaaggugcacguccacuga

SEQ ID NO: 336 - RNA, 4062 nt, Artificial Sequence
  derived and/or modified CDS sequence (opt1) from MERS-CoV__AKN24803__S
auggugcacagcgucuuccugcucauguuccugcugacccccaccgaguccuacguggacgugggcccggacagcgucaaguccgccugcaucgagguggacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacgucuacagcgcgggccacgccaccggcaccacgccccagaagcuguucguggccaacuacucccaggacgugaagcaguucgccaacggguucgucgugcgcaucggcgccgcggccaacagcaccgggaccgugaucaucucccccagcaccuccgccaccauccggaagaucuaccccgccuucaugcugggcagcuccgucgggaacuucagcgacggcaagaugggccgcuucuucaaccacacgcucgugcugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacgucgaccuguacgggggcaacauguuccaguucgccacccugccgguguacgacacgaucaaguacuacagcaucaucccccacuccauccgcagcauccaguccgaccggaaggccugggccgccuucuacguguacaagcuccagccccugaccuuccugcucgacuucagcgucgacggguacauccgccgggcgaucgacugcggcuucaacgaccugucccagcugcacugcagcuacgaguccuucgacguggagagcggcguguacuccgucagcuccuucgaggccaagcccagcggguccgugguggagcaggccgagggcgucgagugcgacuucagcccgcuccuguccgggaccccgccccagguguacaacuucaagcgccuggucuucaccaacugcaacuacaacuucacgaagcuccugagccuguucuccgugaacgacuucacgugcagccagaucagccccgccgccaucgcguccaacugcuacagcucccucauccuggacuacuucagcuacccccuguccaugaaguccgaccucagcgugagcuccgccgggcccaucagccaguucaacuacaagcaguccuucagcaacccgaccugccugauccuggccaccgucccccacaaccucaccaccaucaccaagccccugaaguacuccuacaucaacaagugcagccggcugcucuccgacgaccgcaccgaggugccccagcuggugaacgccaaccaguacagccccugcgucuccaucgugcccagcacggugugggaggacggggacuacuaccggaagcagcugagcccgcucgagggcggcggguggcuggucgccuccggcagcaccguggcgaugaccgagcagcugcagaugggguucggcaucaccgugcaguacgggaccgacacgaacuccgucagccccaagcucgaguucgccaacgacaccaagaucgccucccagcugggcaacugcguggaguacagccuguacggcguguccgggcgcggcgucuuccagaacugcaccgccgugggggugcggcagcagcgcuucgucuacgacgcguaccagaaccucgugggcuacuacagcgacgacggcaacuacuacugccugcgggccugcguguccguccccgugagcgugaucuacgacaaggagaccaagacgcacgccacccuguucggguccgucgccugcgagcacaucagcuccaccaugagccaguacucccgcagcacccgcuccaugcugaagcggcgcgacagcacguacggcccgcuccagacccccguggggugcgugcugggccuggucaacuccagccucuucguggaggacugcaagcugccccuggggcagagccucugcgcccugcccgacaccccguccacccugacgccccggagcgugcgcuccguccccggcgagaugcggcucgcgagcaucgccuucaaccaccccauccagguggaccagcugaacuccagcuacuucaagcuguccaucccgaccaacuucagcuucggcgugacccaggaguacauccagaccacgauccagaaggucaccguggacugcaagcaguacgugugcaacggguuccagaagugcgagcagcuccugcgcgaguacggccaguucugcuccaagaucaaccaggcccugcacggggccaaccuccggcaggacgacagcguccgcaaccuguucgccuccgucaagagcucccagagcucccccaucauccccggcuucgggggcgacuucaaccugacccuccuggagcccgugagcaucuccaccggcagccgguccgcgcgcagcgccaucgaggaccuccuguucgacaaggugacgaucgccgacccgggguacaugcagggcuacgacgacugcaugcagcaggggcccgccagcgcccgggaccugaucugcgcgcaguacguggccggcuacaaggugcugccgccccucauggacgucaacauggaggccgccuacaccuccagccugcugggguccaucgcgggcgugggcuggaccgccgggcucagcuccuucgccgccauccccuucgcccagagcaucuucuaccgccugaacggcguggggaucacccagcagguccuguccgagaaccagaagcucaucgcgaacaaguucaaccaggcccugggcgccaugcagacgggguucaccaccaccaacgaggccuuccggaaggugcaggacgccgugaacaacaacgcgcaggcccugagcaagcucgccuccgagcugagcaacacguucggcgccaucuccgccagcaucggcgacaucauccagcgccuggacguccucgagcaggacgcgcagaucgaccggcugaucaacgggcgccugaccacccucaacgccuucguggcccagcagcuggugcgguccgagagcgccgcgcuguccgcccagcucgccaaggacaaggucaacgagugcgugaaggcccagagcaagcgcuccggcuucugcgggcagggcacccacaucgucagcuucguggugaacgcccccaacggccuguacuucaugcacgucggguacuaccccuccaaccacaucgagguggugagcgcguacggccugugcgacgccgccaaccccacgaacugcaucgccccggucaacggguacuucaucaagaccaacaacacccggaucguggacgaguggagcuacaccggcuccagcuucuacgcccccgagcccaucacgucccucaacaccaaguacguggcgccccaggucaccuaccagaacaucagcaccaaccugccgccgccccugcucgggaacuccaccggcaucgacuuccaggacgagcuggacgaguucuucaagaacgugagcacguccauccccaacuucggcagccugacccagaucaacaccacccuccuggaccugacguacgagaugcucucccugcagcaggucgugaaggcccugaacgagagcuacaucgaccucaaggagcuggggaacuacaccuacuacaacaaguggcccugguacaucuggcugggcuucaucgccgggcucguggcccuggcccugugcguguucuucauccucugcugcaccggcugcgggaccaacugcaugggcaagcugaagugcaaccgcugcugcgaccgcuacgaggaguacgaccuggagccccacaagguccacgugcacuga

SEQ ID NO: 337 - RNA, 4062 nt, Artificial Sequence
  derived and/or modified CDS sequence (opt1) from MERS-CoV__AKN24812__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucugcguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaacuucacgaagcuccugagccuguucuccgucaacgacuucacgugcagccagaucagccccgccgccaucgcguccaacugcuacagcucccucauccuggacuacuucagcuacccccuguccaugaaguccgaccugagcgugagcuccgccgggcccaucagccaguucaacuacaagcaguccuucagcaacccgaccugccugauccuggccaccgugccccacaaccucaccaccaucaccaagccccugaaguacuccuacaucaacaagugcagccggcugcucuccgacgaccgcaccgaggucccccagcuggugaacgccaaccaguacagccccugcguguccaucguccccagcacggugugggaggacggggacuacuaccggaagcagcugagcccgcucgagggcggcggguggcugguggccuccggcagcaccgucgcgaugaccgagcagcugcagaugggguucggcaucaccgugcaguacgggaccgacacgaacuccgugugccccaagcucgaguucgccaacgacaccaagaucgccagccagcugggcaacugcgucgaguacucccuguacggcgugagcgggcgcggcguguuccagaacugcaccgccgucggggugcggcagcagcgcuucguguacgacgcguaccagaaccucgucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcugaagcggcgcgacuccacguacggcccgcuccagacccccgucgggugcgugcugggccuggugaacagcucccucuucgucgaggacugcaagcugccccuggggcagagccucugcgcccugcccgacaccccgagcacccugacgcccugcuccgugcggagcgugcccggcgagaugcgccucgcguccaucgccuucaaccaccccauccaggucgaccagcugaacagcuccuacuucaagcugagcaucccgaccaacuucuccuucggcgugacccaggaguacauccagaccacgauccagaaggugaccgucgacugcaagcaguacgugugcaacggguuccagaagugcgagcagcuccugcgggaguacggccaguucugcagcaagaucaaccaggcccugcacggggccaaccuccgccaggacgacuccgugcggaaccuguucgccagcgucaaguccagccaguccagccccaucauccccggcuucgggggcgacuucaaccugacccuccuggagcccguguccaucagcaccggcucccgcagcgcgcgguccgccaucgaggaccuccuguucgacaaggugacgaucgccgacccgggguacaugcagggcuacgacgacugcaugcagcaggggcccgccagcgcccgcgaccugaucugcgcgcaguacgucgccggcuacaaggugcugccgccccucauggacgugaacauggaggccgccuacaccagcucccugcuggggagcaucgcgggcgucggcuggaccgccgggcucuccagcuucgccgccauccccuucgcccaguccaucuucuaccggcugaacggcguggggaucacccagcagguccugagcgagaaccagaagcucaucgcgaacaaguucaaccaggcccugggcgccaugcagacgggguucaccaccaccaacgaggccuuccgcaaggugcaggacgccgugaacaacaacgcgcaggcccuguccaagcucgccagcgagcuguccaacacguucggcgccaucagcgccuccaucggcgacaucauccagcggcuggacgugcucgagcaggacgcgcagaucgaccgccugaucaacgggcggcugaccacccucaacgccuucgucgcccagcagcuggugcgcagcgaguccgccgcgcugagcgcccagcucgccaaggacaaggugaacgagugcgucaaggcccaguccaagcggagcggcuucugcgggcagggcacccacaucguguccuucgucgugaacgcccccaacggccuguacuucaugcacgugggguacuaccccagcaaccacaucgaggucguguccgcguacggccugugcgacgccgccaaccccacgaacugcaucgccccggugaacggguacuucaucaagaccaacaacacccgcaucgucgacgaguggagcuacaccggcagcuccuucuacgcccccgagcccaucacgagccucaacaccaaguacguggcgccccaggugaccuaccagaacaucuccaccaaccugccgccgccccugcucgggaacagcaccggcaucgacuuccaggacgagcuggacgaguucuucaagaacgucuccacgagcauccccaacuucggcucccugacccagaucaacaccacccuccuggaccugacguacgagaugcucagccugcagcaggucgugaaggcccugaacgaguccuacaucgaccucaaggagcuggggaacuacaccuacuacaacaaguggcccugguacaucuggcugggcuucaucgccgggcucguggcccuggcccugugcguguucuucauccucugcugcaccggcugcgggaccaacugcaugggcaagcucaagagcaaccggugcugcgaccgcuacgaggaguacgaccuggagccccacaaggugcacguccacuga

SEQ ID NO: 338 - RNA, 4062 nt, Artificial Sequence
  derived and/or modified CDS sequence (opt1) from MERS-CoV__AKN24830__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaacuucacgaagcuccugagccuguucuccgucaacgacuucacgugcagccagaucagccccgccgccaucgcguccaacugcuacagcucccucauccuggacuacuucagcuacccccuguccaugaaguccgaccucagcgugagcuccgccgggcccaucagccaguucaacuacaagcaguccuucagcaacccgaccugccugauccuggccaccgugccccacaaccucaccaccaucaccaagccgcugaaguacuccuacaucaacaagugcagccggcugcucuccgacgaccgcaccgaggucccccagcuggugaacgccaaccaguacagccccugcguguccaucguccccagcacggugugggaggacggggacuacuaccggaagcagcugagcccgcucgagggcggcggguggcugguggccuccggccccaccgucgcgaugaccgagcagcugcagaugggguucggcaucaccgugcaguacgggaccgacacgaacagcgugugccccaagcucgaguucgccaacgacaccaagaucgccucccagcugggcaacugcgucgaguacagccuguacggcguguccgggcgcggcguguuccagaacugcaccgccgucggggugcggcagcagcgcuucguguacgacgcguaccagaaccucgucggcuacuacagcgacgacggcaacuacuacugccugcgggccugcguguccgugccggucagcgugaucuacgacaaggagaccaagacgcacgccacccuguucggguccguggccugcgagcacaucagcuccaccaugagccaguacucccgcagcacccgcuccaugcugaagcggcgcgacagcacguacggcccccuccagacccccgucgggugcgugcugggccuggugaacuccagccucuucgucgaggacugcaagcugccccuggggcagucccucugcgcccugccggacacccccagcacccugacgccccggagcgugcgcuccgugcccggcgagaugcggcucgcgagcaucgccuucaaccacccgauccaggucgaccagcugaacuccagcuacuucaagcuguccauccccaccaacuucagcuucggcgugacccaggaguacauccagaccacgauccagaaggugaccgucgacugcaagcaguacgugugcaacggguuccagaagugcgagcagcuccugcgcgaguacggccaguucugcuccaagaucaaccaggcccugcacggggccaaccuccggcaggacgacagcgugcgcaaccuguucgccuccgucaagagcucccagagcucccccaucauccccggcuucgggggcgacuucaaccugacccuccuggagccggugagcaucuccaccggcagccgguccgcgcgcagcgccaucgaggaccuccuguucgacaaggugacgaucgccgaccccggguacaugcagggcuacgacgacugcaugcagcaggggcccgccuccgcccgggaccugaucugcgcgcaguacgucgccggcuacaaggugcugcccccgcucauggacgugaacauggaggccgccuacaccagcagccugcugggguccaucgcgggcgucggcuggaccgccgggcucagcuccuucgccgccauccccuucgcccagagcaucuucuaccgccugaacggcguggggaucacccagcagguccuguccgagaaccagaagcucaucgcgaacaaguucaaccaggcccugggcgccaugcagacgggguucaccaccaccaacgaggccuuccggaaggugcaggacgccgugaacaacaacgcgcaggcccugagcaagcucgccuccgagcugagcaacacguucggcgccaucuccgccagcaucggcgacaucauccagcgccuggacgugcucgagcaggacgcgcagaucgaccggcugaucaacgggcgccugaccacccucaacgccuucgucgcccagcagcuggugcgguccgagagcgccgcgcuguccgcccagcucgccaaggacaaggugaacgagugcgucaaggcccagagcaagcgcuccggcuucugcgggcagggcacccacaucgugagcuucgucgugaacgcccccaacggccuguacuucaugcacgugggguacuaccccuccaaccacaucgaggucgugagcgcguacggccugugcgacgccgccaacccgacgaacugcaucgcccccgugaacggguacuucaucaagaccaacaacacccggaucgucgacgagugguccuacaccggcagcagcuucuacgcccccgagcccaucacgucccucaacaccaaguacguggcgccccaggugaccuaccagaacaucagcaccaaccugcccccgccccugcucgggaacuccaccggcaucgacuuccaggacgagcuggacgaguucuucaagaacgucagcacguccauccccaacuucggcagccugacccagaucaacaccacccuccuggaccugacguacgagaugcucucccugcagcaggucgugaaggcccugaacgagagcuacaucgaccucaaggagcuggggaacuacaccuacuacaacaaguggcccugguacaucuggcugggcuucaucgccgggcucguggcccuggcccugugcguguucuucauccucugcugcaccggcugcgggaccaacugcaugggcaagcugaagugcaaccgcugcugcgaccgcuacgaggaguacgaccuggagccccacaaggugcacguccacuga

SEQ ID NO: 339 - RNA, 4062 nt, Artificial Sequence
  derived and/or modified CDS sequence (opt1) from MERS-CoV__ALB08257__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccgccggcucgacgugcuggagcaggacgcgcagaucgaccgccugaucaacgggcggcucaccacccugaacgccuucgucgcccagcagcuggugcgcagcgaguccgccgcgcucagcgcccagcuggccaaggacaaggugaacgagugcgucaaggcccaguccaagcggagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccgcaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgguacgaggaguacgaccucgagccccacaaggugcacguccacuga

SEQ ID NO: 340 - RNA, 4062 nt, Artificial Sequence
  derived and/or modified CDS sequence (opt1) from MERS-CoV__ALB08311__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggcuacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgggcgcaccgaggucccccagcuggugaacgccaaccaguacagccccugcguguccaucguccccagcacggugugggaggacggcgacuacuaccggaagcagcucagcccgcuggagggcgggggcuggcugguggccuccgggagcaccgucgcgaugaccgagcagcuccagaugggcuucgggaucaccgugcaguacggcaccgacacgaacuccgugugccccaagcuggaguucgccaacgacaccaagaucgccagccagcugggcaacugcgucgaguacucccucuacggggugagcggccgcgggguguuccagaacugcaccgccgucggcgugcggcagcagcgcuucguguacgacgcguaccagaaccuggucggcuacuacuccgacgacgggaacuacuacugccugcgggccugcgugagcgugcccgucuccgugaucuacgacaaggagaccaagacgcacgccacccuguucggcagcguggccugcgagcacaucuccagcaccaugucccaguacagccgcuccacccgcagcaugcucaagcggcgcgacuccacguacgggccgcugcagacccccgucggcugcgugcuggggcucgugaacagcucccuguucgucgaggacugcaagcugccccucggccagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggggugacccaggaguacauccagaccacgauccagaaggugaccgucgacugcaagcaguacgugugcaacggcuuccagaagugcgagcagcugcugcgcgaguacgggcaguucugcagcaagaucaaccaggcccuccacggcgccaaccugcggcaggacgacuccgugcgcaaccuguucgccagcgucaaguccagccaguccagccccaucauccccggguucggcggcgacuucaaccucacccugcuggagcccguguccaucagcaccgggucccggagcgcgcgcuccgccaucgaggaccuccuguucgacaaggugacgaucgccgacccgggcuacaugcagggguacgacgacugcaugcagcagggccccgccagcgcccgggaccugaucugcgcgcaguacgucgccggguacaaggugcucccgccccugauggacgugaacauggaggccgccuacaccagcucccugcucggcagcaucgcgggcgucggguggaccgccggccuguccagcuucgccgccauccccuucgcccaguccaucuucuaccgccugaacggggugggcaucacccagcagguccucagcgagaaccagaagcugaucgcgaacaaguucaaccaggcccugggggccaugcagacgggcuucaccaccaccaacgaggccuuccggaaggugcaggacgccgugaacaacaacgcgcaggcccucuccaagcuggccagcgagcuguccaacacguucggcgccaucagcgccuccaucggggacaucauccagcgccucgacgugcuggagcaggacgcgcagaucgaccggcugaucaacggccgccucaccacccugaacgccuucgucgcccagcagcuggugcggagcgaguccgccgcgcucagcgcccagcuggccaaggacaaggugaacgagugcgucaaggcccaguccaagcgcagcggguucugcggccagggcacccacaucguguccuucgucgugaacgcccccaacgggcuguacuucaugcacgugggcuacuaccccagcaaccacaucgaggucguguccgcguacgggcucugcgacgccgccaaccccacgaacugcaucgccccggugaacggcuacuucaucaagaccaacaacacccggaucgucgacgaguggagcuacaccgggagcuccuucuacgcccccgagcccaucacgagccugaacaccaaguacguggcgccccaggugaccuaccagaacaucuccaccaaccugccgccgccccuccugggcaacagcaccggcaucgacuuccaggacgagcuggacgaguucuucaagaacgucuccacgagcauccccaacuucgggucccucacccagaucaacaccacccugcuggaccucacguacgagaugcugagccugcagcaggucgugaaggcccucaacgaguccuacaucgaccugaaggagcugggcaacuacaccuacuacaacaaguggcccugguacaucuggcucggguucaucgccggccugguggcccuggcccucugcguguucuucauccugugcugcaccgggugcggcaccaacugcaugggcaagcugaagugcaaccgcugcugcgaccgcuacgaggaguacgaccucgagccccacaaggugcacguccacuga

SEQ ID NO: 341 - RNA, 4062 nt, Artificial Sequence
  derived and/or modified CDS sequence (opt1) from MERS-CoV__ALB08322__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggcuacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgggcgcaccgaggucccccagcuggugaacgccaaccaguacagccccugcguguccaucguccccagcacggugugggaggacggcgacuacuaccggaagcagcucagcccgcuggagggcgggggcuggcugguggccuccgggagcaccgucgcgaugaccgagcagcuccagaugggcuucgggaucaccgugcaguacggcaccgacacgaacuccgugugccccaagcuggaguucgccaacgacaccaagaucgccagccagcugggcaacugcgucgaguacucccucuacggggugagcggccgcgggguguuccagaacugcaccgccgucggcgugcggcagcagcgcuucguguacgacgcguaccagaaccuggucggcuacuacuccgacgacgggaacuacuacugccugcgggccugcgugagcgugcccgucuccgugaucuacgacaaggagaccaagacgcacgccacccuguucggcagcguggccugcgagcacaucuccagcaccaugucccaguacagccgcuccacccgcagcaugcucaagcggcgcgacuccacguacgggccgcugcagacccccgucggcugcgugcuggggcucgugaacagcucccuguucgucgaggacugcaagcugccccucggccagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggggugacccaggaguacauccagaccacgauccagaaggugaccgucgacugcaagcaguacgugugcaacggcuuccagaagugcgagcagcugcugcgcgaguacgggcaguucugcagcaagaucaaccaggcccuccacggcgccaaccugcggcaggacgacuccgugcgcaaccuguucgccagcgucaaguccagccaguccagccccaucauccccggguucggcggcgacuucaaccucacccugcuggagcccguguccaucagcaccgggucccggagcgcgcgcuccgccaucgaggaccuccuguucgacaaggugacgaucgccgacccgggcuacaugcagggguacgacgacugcaugcagcagggccccgccagcgcccgggaccugaucugcgcgcaguacgucgccggguacaaggugcucccgccccugauggacgugaacauggaggccgccuacaccagcucccugcucggcagcaucgcgggcgucggguggaccgccggccuguccagcuucgccgccauccccuucgcccaguccaucuucuaccgccugaacggggugggcaucacccagcagguccucagcgagaaccagaagcugaucgcgaacaaguucaaccaggcccugggggccaugcagacgggcuucaccaccaccaacgaggccuuccggaaggugcaggacgccgugaacaacaacgcgcaggcccucuccaagcuggccagcgagcuguccaacacguucggcgccaucagcgccuccaucggggacaucauccagcgccucgacgugcuggagcaggacgcgcagaucgaccggcugaucaacggccgccucaccacccugaacgccuucgucgcccagcagcuggugcggagcgaguccgccgcgcucagcgcccagcuggccaaggacaaggugaacgagugcgucaaggcccaguccaagcgcagcggguucugcggccagggcacccacaucguguccuucgucgugaacgcccccaacgggcuguacuucaugcacgugggcuacuaccccagcaaccacaucgaggucguguccgcguacgggcucugcgacgccgccaaccccacgaacugcaucgccccggugaacggcuacuucaucaagaccaacaacacccggaucgucgacgaguggagcuacaccgggagcuccuucuacgcccccgagcccaucacgagccugaacaccaaguacguggcgccccaggugaccuaccagaacaucuccaccaaccugccgccgccccuccugggcaacagcaccggcaucgacuuccaggacgagcuggacgaguucuucaagaacgucuccacgagcauccccaacuucgggucccucacccagaucaacaccacccugcuggaccucacguacgagaugcugagccugcagcaggucgugaaggcccucaacgaguccuacaucgaccugaaggagcugggcaacuacaccuacuacaacaaguggcccugguacaucuggcucggguucaucgccggccugguggcccuggcccucugcguguucuucauccugugcugcaccgggugcggcaccaacugcaugggcaagcugaagugcaaccgcugcugcgaccgcuacgaggaguacgaccucgagcugcacaaggugcacguccacuga

SEQ ID NO: 342 - RNA, 4062 nt, Artificial Sequence
  derived and/or modified CDS sequence (opt1) from MERS-CoV__ALD51904__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcgccaagaucaaccaggcccuccacggggccaaccugcggcaggacgacagcgugcgcaaccuguucgcguccgucaagagcucccagagcucccccaucauccccggcuucgggggcgacuucaaccucacccugcuggagcccgugagcaucuccaccggcagccgguccgcccgcagcgccaucgaggaccuccuguucgacaaggugacgaucgccgacccgggguacaugcagggcuacgacgacugcaugcagcaggggcccgccuccgcgcgggaccugaucugcgcccaguacgucgccggcuacaaggugcucccgccccugauggacgugaacauggaggccgcguacaccagcagccugcucggguccaucgccggcgucggcuggaccgccgggcugagcuccuucgccgccauccccuucgcgcagagcaucuucuaccgccugaacggcguggggaucacccagcagguccucuccgagaaccagaagcugaucgccaacaaguucaaccaggcccugggcgccaugcagacgggguucaccaccaccaacgaggccuuccggaaggugcaggacgcggugaacaacaacgcccaggcccucagcaagcuggccuccgagcugagcaacacguucggcgccaucuccgcgagcaucggcgacaucauccagcgccucgacgugcuggagcaggacgcccagaucgaccggcugaucaacgggcgccucaccacccugaacgccuucgucgcccagcagcuggugcgguccgagagcgcggcccucuccgcccagcuggccaaggacaaggugaacgagugcgucaaggcccagagcaagcgcuccggcuucugcgggcagggcacccacaucgugagcuucgucgugaacgcgcccaacggccuguacuucaugcacgugggguacuaccccuccaaccacaucgaggucgugagcgccuacggccucugcgacgccgccaaccccacgaacugcaucgccccggugaacggguacuucaucaagaccaacaacacccggaucgucgacgagugguccuacaccggcagcagcuucuacgcgcccgagcccaucacgucccugaacaccaaguacguggcgccccaggugaccuaccagaacaucagcaccaaccugccgccgccccuccuggggaacuccaccggcaucgacuuccaggacgagcuggacgaguucuucaagaacgucagcacguccauccccaacuucggcagccucacccagaucaacaccacccugcuggaccucacguacgagaugcugucccugcagcaggucgugaaggcccucaacgagagcuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 343 - RNA, 4062 nt, Artificial Sequence
  derived and/or modified CDS sequence (opt1) from MERS-CoV__ALJ54446__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacuucuacaccagcuucgccaccuaccacacgcccgccaccgacugcuccgacggcaacuacaaccggaacgccagccucaacuccuucaaggaguacuucaaccugcgcaacugcaccuucauguacaccuacaacaucacggaggacgagauccuggagugguucgggaucacccagaccgcgcagggcgugcaccucuucagcagccgguacguggaccuguacgggggcaacauguuccaguucgccacccugccggucuacgacacgaucaaguacuacuccaucaucccccacagcauccgcuccauccagagcgaccggaaggccugggccgccuucuacguguacaagcuccagccccugaccuuccugcucgacuucuccguggacggguacauccgccgggcgaucgacugcggcuucaacgaccugagccagcugcacugcuccuacgagagcuucgacgucgaguccggcguguacagcguguccagcuucgaggccaagcccuccgggagcgucguggagcaggccgagggcguggagugcgacuucuccccgcuccugagcgggaccccgccccaggucuacaacuucaagcgccugguguucaccaacugcaacuacaaccucacgaagcugcugucccucuucagcgucaacgacuucaucugcucccagaucagccccgccgccaucgcgagcaacugcuacuccagccugauccuggacuacuucuccuacccccucagcaugaaguccgaccugagcguguccagcgccgggcccaucucccaguucaacuacaagcagagcuucuccaacccgaccugccugauccucgccaccgugccccacaaccugaccacgaucaccaagccccugaaguacagcuacaucaacaagugcucccggcuccugagcgacgaccgcaccgaggucccccagcuggugaacgccaaccaguacucccccugcgugagcaucguccccuccaccgugugggaggacggggacuacuaccggaagcagcucagcccgcuggagggcggcggguggcugguggccagcggcuccacggucgcgaugaccgagcagcuccagaugggguucggcaucaccgugcaguacgggaccgacaccaacagcgugugccccaagcuggaguucgccaacgacacgaagaucgccucccagcugggcaacugcgucgaguacagccucuacggcguguccgggcgcggcguguuccagaacugcaccgccgucggggugcggcagcagcgcuucguguacgacgcguaccagaaccuggucggcuacuacagcgacgacggcaacuacuacugccugcgggccugcguguccgugcccgucagcgugaucuacgacaaggagaccaagacccacgccacgcuguucggguccguggccugcgagcacaucagcuccaccaugagccaguacucccgcagcacccgcuccaugcucaagcggcgcgacagcaccuacggcccgcugcagacgcccgucgggugcgugcugggccucgugaacuccagccuguucgucgaggacugcaagcugccccucgggcagucccugugcgcccugcccgacaccccgagcacccucacgccccggagcgugcgcuccgugcccggcgagaugcggcuggcgagcaucgccuucaaccaccccauccaggucgaccagcugaacuccagcuacuucaagcucuccaucccgaccaacuucagcuucggcgugacccaggaguacauccagaccaccauccagaaggugacggucgacugcaagcaguacgugugcaacggguuccagaagugcgagcagcugcugcgcgaguacggccaguucugcuccaagaucaaccaggcccuccacggggccaaccugcggcaggacgacagcgugcgcaaccuguucgccuccgucaagagcucccagagcucccccaucauccccggcuucgggggcgacuucaaccucacccugcuggagcccgugagcaucuccaccggcagccgguccgcgcgcagcgccaucgaggaccuccuguucgacaaggugaccaucgccgacccgggguacaugcagggcuacgacgacugcaugcagcaggggcccgccuccgcccgggaccugaucugcgcgcaguacgucgccggcuacaaggugcucccgccccugauggacgugaacauggaggccgccuacacgagcagccugcucggguccaucgcgggcgucggcuggaccgccgggcugagcuccuucgccgccauccccuucgcccagagcaucuucuaccgccugaacggcguggggaucacccagcagguccucuccgagaaccagaagcugaucgcgaacaaguucaaccaggcccugggcgccaugcagaccggguucacgaccaccaacgaggccuuccggaaggugcaggacgccgugaacaacaacgcgcaggcccucagcaagcuggccuccgagcugagcaacaccuucggcgccaucuccgccagcaucggcgacaucauccagcgccucgacgugcuggagcaggacgcgcagaucgaccggcugaucaacgggcgccucacgacccugaacgccuucgucgcccagcagcuggugcgguccgagagcgccgcgcucuccgcccagcuggccaaggacaaggugaacgagugcgucaaggcccagagcaagcgcuccggcuucugcgggcagggcacccacaucgugagcuucgucgugaacgcccccaacggccuguacuucaugcacgugggguacuaccccuccaaccacaucgaggucgugagcgcguacggccucugcgacgccgccaaccccaccaacugcaucgccccggugaacggguacuucaucaagacgaacaacacccggaucgucgacgagugguccuacaccggcagcagcuucuacgcccccgagcccaucaccucccugaacacgaaguacguggcgccccaggugaccuaccagaacaucagcaccaaccugccgccgccccuccuggggaacuccaccggcaucgacuuccaggacgagcuggacgaguucuucaagaacgucagcaccuccauccccaacuucggcagccucacgcagaucaacaccacccugcuggaccucaccuacgagaugcugucccugcagcaggucgugaaggcccucaacgagagcuacaucgaccugaaggagcuggggaacuacacguacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 344 - RNA, 4062 nt, Artificial Sequence
  derived and/or modified CDS sequence (opt1) from MERS-CoV__ALJ54448__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccauccucaacuccuucaaggaguacuucaaccugcgcaacugcaccuucauguacaccuacaacaucacggaggacgagauccuggagugguucgggaucacccagaccgcgcagggcgugcaccucuucagcagccgguacguggaccuguacgggggcaacauguuccaguucgccacccugccggucuacgacacgaucaaguacuacuccaucaucccccacagcauccgcuccauccagagcgaccggaaggccugggccgccuucuacguguacaagcuccagccccugaccuuccugcucgacuucuccguggacggguacauccgccgggcgaucgacugcggcuucaacgaccugagccagcugcacugcuccuacgagagcuucgacgucgaguccggcguguacagcguguccagcuucgaggccaagcccuccgggagcgucguggagcaggccgagggcguggagugcgacuucuccccgcuccugagcgggaccccgccccaggucuacaacuucaagcgccugguguucaccaacugcaacuacaaccucacgaagcugcugucccucuucagcgucaacgacuucacgugcucccagaucagccccgccgccaucgcgagcaacugcuacuccagccugauccuggacuacuucuccuacccccucagcaugaaguccgaccugagcguguccagcgccgggcccaucucccaguucaacuacaagcagagcuucuccaacccgaccugccugauccucgccaccgugccccacaaccugaccaccaucaccaagccccugaaguacagcuacaucaacaagugcucccggcuccugagcgacgaccgcaccgaggucccccagcuggugaacgccaaccaguacucccccugcgugagcaucguccccuccacggugugggaggacggggacuacuaccggaagcagcucagcccgcuggagggcggcggguggcugguggccagcggcuccaccgucgcgaugaccgagcagcuccagaugggguucggcaucaccgugcaguacgggaccgacacgaacagcgugugccccaagcuggaguucgccaacgacaccaagaucgccucccagcugggcaacugcgucgaguacagccucuacggcguguccgggcgcggcguguuccagaacugcaccgccgucggggugcggcagcagcgcuucguguacgacgcguaccagaaccuggucggcuacuacagcgacgacggcaacuacuacugccugcgggccugcguguccgugcccgucagcgugaucuacgacaaggagaccaagacgcacgccacccuguucggguccguggccugcgagcacaucagcuccaccaugagccaguacucccgcagcacccgcuccaugcucaagcggcgcgacagcacguacggcccgcugcagacccccgucgggugcgugcugggccucgugaacuccagccuguucgucgaggacugcaagcugccccucgggcagucccugugcgcccugcccgacaccccgagcacccucacgccccggagcgugcgcuccgugcccggcgagaugcggcuggcgagcaucgccuucaaccaccccauccaggucgaccagcugaacuccagcuacuucaagcucuccaucccgaccaacuucagcuucggcgugacccaggaguacauccagaccacgauccagaaggugaccgucgacugcaagcaguacgugugcaacggguuccagaagugcgagcagcugcugcgcgaguacggccaguucugcuccaagaucaaccaggcccuccacggggccaaccugcggcaggacgacagcgugcgcaaccuguucgccuccgucaagagcucccagagcucccccaucauccccggcuucgggggcgacuucaaccucacccugcuggagcccgugagcaucuccaccggcagccgguccgcgcgcagcgccaucgaggaccuccuguucgacaaggugacgaucgccgacccgggguacaugcagggcuacgacgacugcaugcagcaggggcccgccuccgcccgggaccugaucugcgcgcaguacgucgccggcuacaaggugcucccgccccugauggacgugaacauggaggccgccuacaccagcagccugcucggguccaucgcgggcgucggcuggaccgccgggcugagcuccuucgccgccauccccuucgcccagagcaucuucuaccgccugaacggcguggggaucacccagcagguccucuccgagaaccagaagcugaucgcgaacaaguucaaccaggcccugggcgccaugcagacgggguucaccaccaccaacgaggccuuccggaaggugcaggacgccgugaacaacaacgcgcaggcccucagcaagcuggccuccgagcugagcaacacguucggcgccaucuccgccagcaucggcgacaucauccagcgccucgacgugcuggagcaggacgcgcagaucgaccggcugaucaacgggcgccucaccacccugaacgccuucgucgcccagcagcuggugcgguccgagagcgccgcgcucuccgcccagcuggccaaggacaaggugaacgagugcgucaaggcccagagcaagcgcuccggcuucugcgggcagggcacccacaucgugagcuucgucgugaacgcccccaacggccuguacuucaugcacgugggguacuaccccuccaaccacaucgaggucgugagcgcguacggccucugcgacgccgccaaccccacgaacugcaucgccccggugaacggguacuucaucaagaccaacaacacccggaucgucgacgagugguccuacaccggcagcagcuucuacgcccccgagcccaucacgucccugaacaccaaguacguggcgccccaggugaccuaccagaacaucagcaccaaccugccgccgccccuccuggggaacuccaccggcaucgacuuccaggacgagcuggacgaguucuucaagaacgucagcacguccauccccaacuucggcagccucacccagaucaacaccacccugcuggaccucacguacgagaugcugucccugcagcaggucgugaaggcccucaacgagagcuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 345 - RNA, 4062 nt, Artificial Sequence
  derived and/or modified CDS sequence (opt1) from MERS-CoV__ALJ54450__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccgguacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccagcgccucgacgugcuggagcaggacgcgcagaucgaccggcugaucaacgggcgccucaccacccugaacgccuucgucgcccagcagcuggugcggagcgaguccgccgcgcucagcgcccagcuggccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccggaucgucgacgaguggagcuacaccggcagcuccuucuacgcccccgagcccaucacgagccugaacaccaaguacguggcgccccaggugaccuaccagaacaucuccaccaaccugccgccgccccuccugagcaacuccaccgggaucgacuuccaggacgagcuggacgaguucuucaagaacgucagcacguccauccccaacuucggcagccucacccagaucaacaccacccugcuggaccucacguacgagaugcugucccugcagcaggucgugaaggcccucaacgagagcuacaucgaccugaaggagcugggcaacuacaccuacuacaacaaguggcccugguacaucuggcucggguucaucgccggccugguggcccuggcccucugcguguucuucauccugugcugcaccgggugcggcaccaacugcauggggaagcugaagugcaaccgcugcugcgaccgcuacgaggaguacgaccucgagccccacaaggugcacguccacuga

SEQ ID NO: 346 - RNA, 4062 nt, Artificial Sequence
  derived and/or modified CDS sequence (opt1) from MERS-CoV__ALJ54453__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaacuacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccagcgccucgacgugcuggagcaggacgcgcagaucgaccggcugaucaacgggcgccucaccacccugaacgccuucgucgcccagcagcuggugcggagcgaguccgccgcgcucagcgcccagcuggccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccggaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 347 - RNA, 4062 nt, Artificial Sequence
  derived and/or modified CDS sequence (opt1) from MERS-CoV__ALJ54455__S
augauccacagcguguuccugcucauguuccugcugacccccaccgaguccuacgucgacgugggcccggacagcgugaaguccgccugcaucgccgucgacauccagcagacguucuucgacaagaccuggccccgccccaucgacgugagcaaggcggacgggaucaucuacccccagggccggaccuacuccaacaucaccaucacguaccagggccucuucccguaccagggcgaccacggggacauguacguguacagcgccggccacgccaccggcaccacgccccagaagcuguucgucgccaacuacucccaggacgugaagcaguucgccaacggguucgugguccgcaucggcgcggccgccaacagcaccgggaccgugaucaucucccccagcaccuccgccaccauccggaagaucuaccccgcguucaugcugggcagcuccguggggaacuucagcgacggcaagaugggccgcuucuucaaccacacgcucguccugcugccggacgggugcggcacccuccugcgggccuucuacugcauccuggagccccgcuccgggaaccacugccccgccggcaacagcuacaccuccuucgccaccuaccacacgcccgccaccgacugcagcgacggcaacuacaaccggaacgcgucccucaacagcuucaaggaguacuucaaccugcgcaacugcaccuucauguacaccuacaacaucacggaggacgagauccuggagugguucgggaucacccagaccgcccagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgcguucuacguguacaagcuccagccccugaccuuccugcucgacuucagcguggacggguacauccgccgggccaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgcgaucgccuccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggcguccggcagcaccgucgccaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgcggucggggugcggcagcagcgcuucguguacgacgccuaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaagcucaagcggcgcgacuccacguacggcccgcugcagacccccgucgggugcgugcugggccucgugaacagcucccuguucgucgaggacugcaagcugccccucgggcagagccugugcgcgcugcccgacaccccgagcacccucaagccccgguccgugcgcagcgugcccggcgagaugcggcuggccuccaucgccuucaaccaccccauccaggucgaccagcugaacagcuccuacuucaagcucagcaucccgacgaacuucuccuucggcgugacccaggaguacauccagaccaccauccagaaggugacggucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgcgagcgucaaguccagccaguccagccccaucauccccggcuucgggggcgacuucaaccucacccugcuggagcccguguccaucagcaccggcucccggagcgcccgcuccgccaucgaggaccuccuguucgacaaggugaccaucgccgacccgggguacaugcagggcuacgacgacugcaugcagcaggggcccgccagcgcgcgggaccugaucugcgcccaguacgucgccggcuacaaggugcucccgccccugauggacgugaacauggaggccgcguacacgagcucccugcucgggagcaucgccggcgucggcuggaccgccgggcuguccagcuucgccgccauccccuucgcgcaguccaucuucuaccgccugaacggcguggggaucacccagcagguccucagcgagaaccagaagcugaucgccaacaaguucaaccaggcccugggcgccaugcagaccggguucacgaccaccaacgaggccuuccggaaggugcaggacgcggugaacaacaacgcccaggcccucuccaagcuggccagcgagcuguccaacaccuucggcgccaucagcgcguccaucggcgacaucauccagcgccucgacgugcuggagcaggacgcccagaucgaccggcugaucaacgggcgccucacgacccugaacgccuucgucgcccagcagcuggugcggagcgaguccgcggcccucagcgcccagcuggccaaggacaaggugaacgagugcgucaaggcccaguccaagcgcagcggcuucugcgggcagggcacccacaucguguccuucgucgugaacgcgcccaacggccuguacuucaugcacgugggguacuaccccagcaaccacaucgaggucguguccgccuacggccucugcgacgccgccaaccccaccaacugcaucgccccggugaacggguacuucaucaagacgaacaacacccggaucgucgacgaguggagcuacaccggcagcuccuucuacgcgcccgagcccaucaccagccugaacacgaaguacguggcgccccaggugaccuaccagaacaucuccaccaaccugccgccgccccuccuggggaacagcaccggcaucgacuuccaggacgagcuggacgaguucuucaagaacgucuccaccagcauccccaacuucggcucccucacgcagaucaacaccacccugcuggaccucaccuacgagaugcugagccugcagcaggucgugaaggcccucaacgaguccuacaucgaccugaaggagcuggggaacuacacguacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 348 - RNA, 4062 nt, Artificial Sequence
  derived and/or modified CDS sequence (opt1) from MERS-CoV__ALJ54456__S
augauccacagcguguuccugcucauguuccugcugacccccaccgaguccuacgucgacgugggcccggacagcgugaaguccgccugcaucgccgucgacauccagcagacguucuucgacaagaccuggccccgccccaucgacgugagcaaggcggacgggaucaucuacccccagggccggaccuacuccaacaucaccaucacguaccagggccucuucccguaccagggcgaccacggggacauguacguguacagcgccggccacgccaccggcaccacgccccagaagcuguucgucgccaacuacucccaggacgugaagcaguucgccaacggguucgugguccgcaucggcgcggccgccaacagcaccgggaccgugaucaucucccccagcaccuccgccaccauccggaagaucuaccccgcguucaugcugggcagcuccguggggaacuucagcgacggcaagaugggccgcuucuucaaccacacgcucguccugcugccggacgggugcggcacccuccugcgggccuucuacugcauccuggagccccgcuccgggaaccacugccccgccggcaacagcuacaccuccuucgccaccuaccacacgcccgccaccgacugcagcgacggcaacuacaaccggaacgcgucccucaacagcuucaaggaguacuucaaccugcgcaacugcaccuucauguacaccuacaacaucacggaggacgagauccuggagugguucgggaucacccagaccgcccagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgcguucuacguguacaagcuccagccccugaccuuccugcucgacuucagcguggacggguacauccgccgggccaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgcgaucgccuccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggcguccggcagcaccgucgccaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgcggucggggugcggcagcagcgcuucguguacgacgccuaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcgcugcccgacaccccgagcacccucaagccccgguccgugcgcagcgugcccggcgagaugcggcuggccuccaucgccuucaaccaccccauccaggucgaccagcugaacagcuccuacuucaagcucagcaucccgacgaacuucuccuucggcgugacccaggaguacauccagaccaccauccagaaggugacggucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgcgagcgucaaguccagccaguccagccccaucauccccggcuucgggggcgacuucaaccucacccugcuggagcccguguccaucagcaccggcucccggagcgcccgcuccgccaucgaggaccuccuguucgacaaggugaccaucgccgacccgggguacaugcagggcuacgacgacugcaugcagcaggggcccgccagcgcgcgggaccugaucugcgcccaguacgucgccggcuacaaggugcucccgccccugauggacgugaacauggaggccgcguacacgagcucccugcucgggagcaucgccggcgucggcuggaccgccgggcuguccagcuucgccgccauccccuucgcgcaguccaucuucuaccgccugaacggcguggggaucacccagcagguccucagcgagaaccagaagcugaucgccaacaaguucaaccaggcccugggcgccaugcagaccggguucacgaccaccaacgaggccuuccggaaggugcaggacgcggugaacaacaacgcccaggcccucuccaagcuggccagcgagcuguccaacaccuucggcgccaucagcgcguccaucggcgacaucauccagcgccucgacgugcuggagcaggacgcccagaucgaccggcugaucaacgggcgccucacgacccugaacgccuucgucgcccagcagcuggugcggagcgaguccgcggcccucagcgcccagcuggccaaggacaaggugaacgagugcgucaaggcccaguccaagcgcagcggcuucugcgggcagggcacccacaucguguccuucgucgugaacgcgcccaacggccuguacuucaugcacgugggguacuaccccagcaaccacaucgaggucguguccgccuacggccucugcgacgccgccaaccccaccaacugcaucgccccggugaacggguacuucaucaagacgaacaacacccggaucgucgacgaguggagcuacaccggcagcuccuucuacgcgcccgagcccaucaccagccugaacacgaaguacguggcgccccaggugaccuaccagaacaucuccaccaaccugccgccgccccuccuggggaacagcaccggcaucgacuuccaggacgagcuggacgaguucuucaagaacgucuccaccagcauccccaacuucggcucccucacgcagaucaacaccacccugcuggaccucaccuacgagaugcugagccugcagcaggucgugaaggcccucaacgaguccuacaucgaccugaaggagcuggggaacuacacguacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 349 - RNA, 4062 nt, Artificial Sequence
  derived and/or modified CDS sequence (opt1) from MERS-CoV__ALJ54461__S
augauccacagcguguuccugcucauguuccugcugacccccaccgaguccuacgucgacgugggcccggacagcgugaagcccgccugcaucgaggucgacauccagcagacguucuucgacaagaccuggccccgccccaucgacguguccaaggccgacgggaucaucuacccgcagggccggaccuacagcaacaucaccaucacguaccagggccucuuccccuaccagggcgaccacggggacauguacguguacuccgcgggccacgccaccggcaccacgccccagaagcuguucgucgccaacuacagccaggacgugaagcaguucgccaacggguucgugguccgcaucggcgccgcggccaacuccaccgggaccgugaucaucagccccuccaccagcgccaccauccggaagaucuacccggccuucaugcugggcuccagcguggggaacuucuccgacggcaagaugggccgcuucuucaaccacacgcucguccugcugcccgacgggugcggcacccuccugcgggcguucuacugcauccuggagccccgcagcgggaaccacugccccgccggcaacuccuacaccagcuucgccaccuaccacacgccggccaccgacugcuccgacggcaacuacaaccggaacgccagccucaacuccuucaaggaguacuucaaccugcgcaacugcaccuucauguacaccuacaacaucacggaggacgagauccuggagugguucgggaucacccagaccgcgcagggcgugcaccucuucagcagccgguacguggaccuguacgggggcaacauguuccaguucgccacccugcccgucuacgacacgaucaaguacuacuccaucaucccccacagcauccgcuccauccagagcgaccggaaggccugggccgccuucuacguguacaagcuccagccccugaccuuccugcucgacuucuccguggacggguacauccgccgggcgaucgacugcggcuucaacgaccugagccagcugcacugcuccuacgagagcuucgacgucgaguccggcguguacagcguguccagcuucgaggccaagccguccgggagcgucguggagcaggccgagggcguggagugcgacuucagcccccuccuguccgggaccccgccccaggucuacaacuucaagcgccugguguucaccaacugcaacuacaaccucacgaagcugcugucccucuucagcgucaacgacuucacgugcucccagaucagccccgccgccaucgcgagcaacugcuacuccagccugauccuggacuacuucuccuacccccucagcaugaaguccgaccugagcgugaccuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcacggaggucccccagcuggugaacgccaaccaguacagccccugcguguccaucgucccgagcaccgugugggaggacggggacuacuaccggaagcagcucagcccccuggagggcggcggguggcugguggccuccggcagcaccgucgcgaugaccgagcagcuccagaugggguucggcaucaccgugcaguacgggacggacaccaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugccggucuccgugaucuacgacaaggagacgaagacccacgccacccuguucgggagcguggccugcgagcacaucuccagcaccaugucccaguacagccgcuccacgcgcagcaugcucaagcggcgcgacuccaccuacggcccccugcagaccagcgucgggugcgugcugggccucgugaacuccagccuguucgucgaggacugcaagcugccccucgggcagucccugugcgcccugcccgacaccccgagcacgcucacgccccggagcgugcgcuccgugcccggcgagaugcggcuggcgagcaucgccuucaaccaccccauccaggucgaccagcugaacuccagcuacuucaagcucuccaucccgaccaacuucagcuucggcgugacccaggaguacauccagaccaccauccagaaggugaccgucgacugcaagcaguacgugugcaacggguuccagaagugcgagcagcugcugcgcgaguacggccaguucugcuccaagaucaaccaggcccuccacggggccaaccugcggcaggacgacagcgugcgcaaccuguucgccuccgucaagagcucccagagcucccccaucauccccggcuucgggggcgacuucaaccucacccugcuggagcccgugagcaucuccacgggcagccgguccgcgcgcagcgccaucgaggaccuccuguucgacaaggugaccaucgccgacccgggguacaugcagggcuacgacgacugcaugcagcaggggcccgccuccgcccgggaccugaucugcgcgcaguacgucgccggcuacaaggugcucccgccccugauggacgugaacauggaggccgccuacaccagcagccugcucggguccaucgcgggcgucggcuggaccgccgggcugagcuccuucgccgccauccccuucgcccagagcaucuucuaccgccugaacggcguggggaucacgcagcagguccucuccgagaaccagaagcugaucgcgaacaaguucaaccaggcccugggcgccaugcagaccggguucaccaccacgaacgaggccuuccggaaggugcaggacgccgugaacaacaacgcgcaggcccucagcaagcuggccuccgagcugagcaacaccuucggcgccaucuccgccagcaucggcgacaucauccagcgccucgacgugcuggagcaggacgcgcagaucgaccggcugaucaacgggcgccucaccacccugaacgccuucgucgcccagcagcuggugcgguccgagagcgccgcgcucuccgcccagcuggccaaggacaaggugaacgagugcgucaaggcccagagcaagcgcuccggcuucugcgggcagggcacgcacaucgugagcuucgucgugaacgcccccaacggccuguacuucaugcacgugggguacuaccccuccaaccacaucgaggucgugagcgcguacggccucugcgacgccgccaaccccaccaacugcaucgccccggugaacggguacuucaucaagaccaacaacacccggaucgucgacgagugguccuacacgggcagcagcuucuacgcccccgagcccaucaccucccugaacaccaaguacguggcgccccaggugaccuaccagaacaucagcaccaaccugccgccgccccuccuggggaacuccacgggcaucgacuuccaggacgagcuggacgaguucuucaagaacgucagcaccuccauccccaacuucggcagccucacccagaucaacaccacgcugcuggaccucaccuacgagaugcugucccugcagcaggucgugaaggcccucaacgagagcuacaucgaccugaaggagcuggggaacuacaccuacuacaacaaguggcccugguacaucuggcucggcuucaucgccgggcugguggcccuggcccucugcguguucuucauccugugcugcaccggcugcgggacgaacugcaugggcaagcugaagugcaaccgcugcugcgaccgcuacgaggaguacgaccucgagccccacaaggugcacguccacuga

SEQ ID NO: 350 - RNA, 4062 nt, Artificial Sequence
  derived and/or modified CDS sequence (opt1) from MERS-CoV__ALJ54468__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucaucugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccacgaucaccaagccccugaaguacuccuacaucaacaagugcagccggcuccuguccgacgaccgcaccgaggucccccagcuggugaacgccaaccaguacagccccugcguguccaucguccccagcaccgugugggaggacggggacuacuaccggaagcagcucagcccgcuggagggcggcggguggcugguggccuccggcagcacggucgcgaugaccgagcagcuccagaugggguucggcaucaccgugcaguacgggaccgacaccaacuccgugugccccaagcuggaguucgccaacgacacgaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacccacgccacgcuguucgggagcguggccugcgagcacaucuccagcaccaugucccaguacagccgcuccacccgcagcaugcucaagcggcgcgacuccaccuacggcccgcugcagacgcccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccaccauccagaaggugacggucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugaccaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacacgagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagaccggguucacgaccaccaacgaggccuuccggaaggugcaggacgccgugaacaacaacgcgcaggcccucuccaagcuggccagcgagcuguccaacaccuucggcgccaucagcgccuccaucggcgacaucauccagcgccucgacgugcuggagcaggacgcgcagaucgaccggcugaucaacgggcgccucacgacccugaacgccuucgucgcccagcagcuggugcggagcgaguccgccgcgcucagcgcccagcuggccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccaccaacugcaucgccccggugaacggguacuucaucaagacgaacaacacccggaucgucgacgaguggagcuacaccggcagcuccuucuacgcccccgagcccaucaccagccugaacacgaaguacguggcgccccaggugaccuaccagaacaucuccaccaaccugccgccgccccuccuggggaacagcaccggcaucgacuuccaggacgagcuggacgaguucuucaagaacgucuccaccagcauccccaacuucggcucccucacgcagaucaacaccacccugcuggaccucaccuacgagaugcugagccugcagcaggucgugaaggcccucaacgaguccuacaucgaccugaaggagcuggggaacuacacguacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 351 - RNA, 4062 nt, Artificial Sequence
  derived and/or modified CDS sequence (opt1) from MERS-CoV__ALJ54471__S
augauccacagcguguaccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccagcgccucgacgugcuggagcaggacgcgcagaucgaccggcugaucaacgggcgccucaccacccugaacgccuucgucgcccagcagcuggugcggagcgaguccgccgcgcucagcgcccagcuggccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccggaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccacaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 352 - RNA, 4062 nt, Artificial Sequence
  derived and/or modified CDS sequence (opt1) from MERS-CoV__ALJ54472__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcugcagcagcgguucguguacgacgcguaccagaaccuggucggcuacuacuccgacgacggcaacuacuacugccugcgcgccugcgugagcgugcccgucuccgugaucuacgacaaggagaccaagacgcacgccacccucuucgggagcguggccugcgagcacaucuccagcaccaugucccaguacagccgguccacccgcagcaugcugaagcgccgggacuccacguacggcccgcugcagacccccgucgggugcgugcucggccuggugaacagcucccuguucgucgaggacugcaagcucccccuggggcagagccugugcgcccuccccgacaccccgagcacccuggcgccccgcuccgugcggagcgugcccggcgagaugcgccuggccuccaucgccuucaaccaccccauccaggucgaccagcucaacagcuccuacuucaagcugagcaucccgacgaacuucuccuucggcgugacccaggaguacauccagaccaccauccagaaggugacggucgacugcaagcaguacgugugcaacggguuccagaagugcgagcagcugcuccgggaguacggccaguucugcagcaagaucaaccaggcccugcacggggccaaccugcgccaggacgacuccgugcggaaccucuucgcgagcgucaaguccagccaguccagccccaucauccccggcuucgggggcgacuucaaccugacccugcucgagcccguguccaucagcaccggcucccgcagcgcccgguccgccaucgaggaccugcuguucgacaaggugaccaucgccgacccgggguacaugcagggcuacgacgacugcaugcagcaggggcccgccagcgcgcgcgaccucaucugcgcccaguacgucgccggcuacaaggugcugccgccccugauggacgugaacauggaggccgcguacacgagcucccuccuggggagcaucgccggcgucggcuggaccgccgggcuguccagcuucgccgccauccccuucgcgcaguccaucuucuaccggcucaacggcguggggaucacccagcagguccugagcgagaaccagaagcugaucgccaacaaguucaaccaggcccucggcgccaugcagaccggguucacgaccaccaacgaggccuuccgcaaggugcaggacgcggugaacaacaacgcccaggcccuguccaagcuggccagcgagcucuccaacaccuucggcgccaucagcgcguccaucggcgacaucauccagcggcuggacgugcuggagcaggacgcccagaucgaccgccucaucaacgggcggcugacgacccugaacgccuucgucagccagcagcucgugcgcuccgagagcgccgcgcuguccgcccagcuggccaaggacaaggugaacgagugcgucaaggcccagagcaagcgguccggcuucugcgggcagggcacccacaucgugagcuucgucgugaacgcccccaacggccucuacuucaugcacgugggguacuaccccuccaaccacaucgaggucgugagcgcguacggccugugcgacgccgccaaccccaccaacugcaucgccccggugaacggguacuucaucaagacgaacaacacccgcaucgucgacgaguggagcuacaccggcuccagcuucuacgcccccgagcccaucaccucccugaacacgaaguacguggcgccccaggugaccuaccagaacaucagcaccaaccucccgccgccccugcuggggaacuccaccggcaucgacuuccaggacgagcucgacgaguucuucaagaacgucagcaccuccauccccaacuucggcagccugacgcagaucaacaccacccugcucgaccugaccuacgagaugcugucccuccagcaggucgugaaggcccugaacgagagcuacaucgaccugaaggagcucgggaacuacacguacuacaacaaguggcccugguacaucuggcugggcuucaucgccgggcugguggcccucgcccugugcguguucuucauccugugcugcaccggcugcgggaccaacugcaugggcaagcucaagugcaaccggugcugcgaccgcuacgaggaguacgaccuggagccccacaaggugcacguccacuga

SEQ ID NO: 353 - RNA, 4062 nt, Artificial Sequence
  derived and/or modified CDS sequence (opt1) from MERS-CoV__ALJ54474__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccagcaccgacugcuccgacggcaacuacaaccggaacgccagccucaacagcuucaaggaguacuucaaccugcgcaacugcaccuucauguacaccuacaacaucacggaggacgagauccuggagugguucgggaucacccagaccgcccagggcgugcaccucuucuccagccgguacguggaccuguacgggggcaacauguuccaguucgcgacccugccggucuacgacacgaucaaguacuacuccaucaucccccacagcauccgcuccauccagagcgaccggaaggccugggccgccuucuacguguacaagcuccagccccugaccuuccugcucgacuucuccguggacggguacauccgccgggccaucgacugcggcuucaacgaccugagccagcugcacugcuccuacgagagcuucgacgucgaguccggcguguacagcguguccagcuucgaggcgaagcccuccgggagcgucguggagcaggccgagggcguggagugcgacuucuccccgcuccugagcgggaccccgccccaggucuacaacuucaagcgccugguguucaccaacugcaacuacaaccucacgaagcugcugucccucuucagcgucaacgacuucacgugcagccagaucucccccgccgccaucgccagcaacugcuacuccagccugauccuggacuacuucuccuacccccucagcaugaaguccgaccugagcguguccagcgcggggcccaucucccaguucaacuacaagcagagcuucuccaacccgaccugccugauccucgccaccgugccccacaaccugaccaccaucaccaagccccugaaguacagcuacaucaacaagugcucccggcuccugagcgacgaccgcaccgaggucccccagcuggugaacgccaaccaguacucccccugcgugagcaucguccccagcacggugugggaggacggggacuacuaccggaagcagcucuccccgcuggagggcggcggguggcugguggccagcggcuccaccgucgccaugaccgagcagcuccagaugggguucggcaucaccgugcaguacgggaccgacacgaacagcgugugccccaagcuggaguucgcgaacgacaccaagaucgccucccagcugggcaacugcgucgaguacagccucuacggcguguccgggcgcggcguguuccagaacugcaccgccgucggggugcggcagcagcgcuucguguacgacgccuaccagaaccuggucggcuacuacagcgacgacggcaacuacuacugccugcgggcgugcguguccgugcccgucagcgugaucuacgacaaggagaccaagacgcacgccacccuguucggguccguggccugcgagcacaucagcuccaccaugagccaguacucccgcagcacccgcuccaugcucaagcggcgcgacagcacguacggcccgcugcagacccccgucgggugcgugcugggccucgugaacuccagccuguucgucgaggacugcaagcugccccucgggcagagccugugcgcccugcccgacaccccguccacccucacgccccggagcgugcgcuccgugcccggcgagaugcggcuggccagcaucgcguucaaccaccccauccaggucgaccagcugaacuccagcuacuucaagcucuccaucccgaccaacuucagcuucggcgugacccaggaguacauccagaccacgauccagaaggugaccgucgacugcaagcaguacgugugcaacggguuccagaagugcgagcagcugcugcgcgaguacggccaguucugcuccaagaucaaccaggcccuccacggggccaaccugcggcaggacgacagcgugcgcaaccuguucgccuccgucaagagcucccagagcucccccaucauccccggcuucgggggcgacuucaaccucacccugcuggagcccgugagcaucuccaccggcagccgguccgcccgcagcgcgaucgaggaccuccuguucgacaaggugacgaucgccgacccgggguacaugcagggcuacgacgacugcaugcagcaggggcccgccagcgcccgggaccugaucugcgcccaguacgucgcgggcuacaaggugcucccgccccugauggacgugaacauggaggccgccuacaccuccagccugcucggguccaucgccggcgucggcuggaccgcggggcugagcuccuucgccgccauccccuucgcccagagcaucuucuaccgccugaacggcguggggaucacccagcagguccucuccgagaaccagaagcugaucgccaacaaguucaaccaggcgcugggcgccaugcagacgggguucaccaccaccaacgaggccuuccggaaggugcaggacgccgugaacaacaacgcccaggcgcucagcaagcuggccuccgagcugagcaacacguucggcgccaucuccgccagcaucggcgacaucauccagcgccucgacgugcuggagcaggacgcccagaucgaccggcugaucaacgggcgccucaccacccugaacgcguucgucgcccagcagcuggugcgguccgagagcgccgcccucuccgcgcagcuggccaaggacaaggugaacgagugcgucaaggcccagagcaagcgcuccggcuucugcgggcagggcacccacaucgugagcuucgucgugaacgcccccaacggccuguacuucaugcacgugggguacuaccccuccaaccacaucgaggucgugagcgccuacggccucugcgacgcggccaaccccacgaacugcaucgccccggugaacggguacuucaucaagaccaacaacacccgggucguggacgaguggagcuacaccggcuccagcuucuacgcccccgagcccaucacgucccugaacaccaaguacguggcgccccaggucaccuaccagaacaucagcaccaaccugccgccgccccuccuguccaacagcaccgggaucgacuuccaggacgagcuggacgaguucuucaagaacguguccacgagcauccccaacuucggcucccucacccagaucaacaccacccugcuggaccucacguacgagaugcugagccugcagcaggucgugaaggcccucaacgaguccuacaucgaccugaaggagcugggcaacuacaccuacuacaacaaguggcccugguacaucuggcucggguucaucgccggccugguggcccuggcccucugcguguucuucauccugugcugcaccgggugcggcaccaacugcauggggaagcugaagugcaaccgcugcugcgaccgcuacgaggaguacgaccucgagccccacaagguccacgugcacuga

SEQ ID NO: 354 - RNA, 4062 nt, Artificial Sequence
  derived and/or modified CDS sequence (opt1) from MERS-CoV__ALJ54483__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucuuccaguucaacuacaagcagagcuucuccaacccgaccugccugauccucgccaccgugccccacaaccugaccaccaucaccaagccccugaaguacagcuacaucaacaagugcucccggcuccugagcgacgaccgcaccgaggucccccagcuggugaacgccaaccaguacucccccugcgugagcaucguccccuccacggugugggaggacggggacuacuaccggaagcagcucagcccgcuggagggcggcggguggcugguggccagcggcuccaccgucgcgaugaccgagcagcuccagaugggguucggcaucaccgugcaguacgggaccgacacgaacagcgugugccccaagcuggaguucgccaacgacaccaagaucgccucccagcugggcaacugcgucgaguacagccucuacggcguguccgggcgcggcguguuccagaacugcaccgccgucggggugcggcagcagcgcuucguguacgacgcguaccagaaccuggucggcuacuacagcgacgacggcaacuacuacugccugcgggccugcguguccgugcccgucagcgugaucuacgacaaggagaccaagacgcacgccacccuguucggguccguggccugcgagcacaucagcuccaccaugagccaguacucccgcagcacccgcuccaugcucaagcggcgcgacagcacguacggcccgcugcagacccccgucgggugcgugcugggccucgugaacuccagccuguucgucgaggacugcaagcugccccucgggcagucccugugcgcccugcccgacaccccgagcacccucacgccccggagcgugcgcuccgugcccggcgagaugcggcuggcgagcaucgccuucaaccaccccauccaggucgaccagcugaacuccagcuacuucaagcucuccaucccgaccaacuucagcuucggcgugacccaggaguacauccagaccacgauccagaaggugaccgucgacugcaagcaguacgugugcaacggguuccagaagugcgagcagcugcugcgcgaguacggccaguucugcuccaagaucaaccaggcccuccacggggccaaccugcggcaggacgacagcgugcgcaaccuguucgccuccgucaagagcucccagagcucccccaucauccccggcuucgggggcgacuucaaccucacccugcuggagcccgugagcaucuccaccggcagccgguccgcgcgcagcgccaucgaggaccuccuguucgacaaggugacgaucgccgacccgggguacaugcagggcuacgacgacugcaugcagcaggggcccgccuccgcccgggaccugaucugcgcgcaguacgucgccggcuacaaggugcucccgccccugauggacgugaacauggaggccgccuacaccagcagccugcucggguccaucgcgggcgucggcuggaccgccgggcugagcuccuucgccgccauccccuucgcccagagcaucuucuaccgccugaacggcguggggaucacccagcagguccucuccgagaaccagaagcugaucgcgaacaaguucaaccaggcccugggcgccaugcagacgggguucaccaccaccaacgaggccuuccggaaggugcaggacgccgugaacaacaacgcgcaggcccucagcaagcuggccuccgagcugagcaacacguucggcgccaucuccgccagcaucggcgacaucauccagcgccucgacgugcuggagcaggacgcgcagaucgaccggcugaucaacgggcgccucaccacccugaacgccuucgucgcccagcagcuggugcgguccgagagcgccgcgcucuccgcccagcuggccaaggacaaggugaacgagugcgucaaggcccagagcaagcgcuccggcuucugcgggcagggcacccacaucgugagcuucgucgugaacgcccccaacggccuguacuucaugcacgugggguacuaccccuccaaccacaucgaggucgugagcgcguacggccucugcgacgccgccaaccccacgaacugcaucgccccggugaacggguacuucaucaagaccaacaacacccggaucgucgacgagugguccuacaccggcagcagcuucuacgcccccgagcccaucacgucccugaacaccaaguacguggcgccccaggugaccuaccagaacaucagcaccaaccugccgccgccccuccuggggaacuccaccggcaucgacuuccaggacgagcuggacgaguucuucaagaacgucagcacguccauccccaacuucggcagccucacccagaucaacaccacccugcuggaccucacguacgagaugcugucccugcagcaggucgugaaggcccucaacgagagcuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 355 - RNA, 4062 nt, Artificial Sequence
  derived and/or modified CDS sequence (opt1) from MERS-CoV__ALJ54486__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccgguacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggucuccggcagcaccguggccaugaccgagcagcuccagaugggguucggcaucaccgugcaguacgggaccgacacgaacuccgucugccccaagcuggaguucgcgaacgacaccaagaucgccagccagcugggcaacugcguggaguacucccucuacggcgugagcgggcgcggcgucuuccagaacugcaccgccgugggggugcggcagcagcgcuucgucuacgacgccuaccagaaccuggugggcuacuacuccgacgacggcaacuacuacugccugcgggcgugcgugagcguccccguguccgugaucuacgacaaggagaccaagacgcacgccacccuguucgggagcgucgccugcgagcacaucuccagcaccaugucccaguacagccgcuccacccgcagcaugcucaagcggcgcgacuccacguacggcccgcugcagacccccguggggugcgugcugggccucgucaacagcucccuguucguggaggacugcaagcugccccucgggcagagccugugcgcccugcccgacaccccgagcacccucacgccccgguccgugcgcagcguccccggcgagaugcggcuggccuccaucgcguucaaccaccccauccagguggaccagcugaacagcuccuacuucaagcucagcaucccgaccaacuucuccuucggcgugacccaggaguacauccagaccacgauccagaaggucaccguggacugcaagcaguacgugugcaacggguuccagaagugcgagcagcugcugcgcgaguacggccaguucugcagcaagaucaaccaggcccuccacggggccaaccugcggcaggacgacuccguccgcaaccuguucgccagcgugaaguccagccaguccagccccaucauccccggcuucgggggcgacuucaaccucacccugcuggagcccguguccaucagcaccggcucccggagcgcccgcuccgcgaucgaggaccuccuguucgacaaggucacgaucgccgacccgggguacaugcagggcuacgacgacugcaugcagcaggggcccgccagcgcccgggaccugaucugcgcccaguacguggcgggcuacaaggugcucccgccccugauggacgucaacauggaggccgccuacaccagcucccugcucgggagcaucgccggcgugggcuggaccgcggggcuguccagcuucgccgccauccccuucgcccaguccaucuucuaccgccugaacggcguggggaucacccagcagguccucagcgagaaccagaagcugaucgccaacaaguucaaccaggcgcugggcgccaugcagacgggguucaccaccaccaacgaggccuuccggaaggugcaggacgccgugaacaacaacgcccaggcgcucuccaagcuggccagcgagcuguccaacacguucggcgccaucagcgccuccaucggcgacaucauccagcgccucgacguccuggagcaggacgcccagaucgaccggcugaucaacgggcgccucaccacccugaacgcguucguggcccagcagcuggugcggagcgaguccgccgcccucagcgcgcagcuggccaaggacaaggucaacgagugcgugaaggcccaguccaagcgcagcggcuucugcgggcagggcacccacaucgucuccuucguggugaacgcccccaacggccuguacuucaugcacgucggguacuaccccagcaaccacaucgaggugguguccgccuacggccucugcgacgcggccaaccccacgaacugcaucgccccggucaacggguacuucaucaagaccaacaacacccggaucguggacgaguggagcuacaccggcagcuccuucuacgcccccgagcccaucacgagccugaacaccaaguacguggcgccccaggucaccuaccagaacaucuccaccaaccugccgccgccccuccugagcaacuccaccgggaucgacuuccaggacgagcuggacgaguucuucaagaacgugagcacguccauccccaacuucggcagccucacccagaucaacaccacccugcuggaccucacguacgagaugcugucccugcagcaggucgugaaggcccucaacgagagcuacaucgaccugaaggagcugggcaacuacaccuacuacaacaaguggcccugguacaucuggcucggguucaucgccggccugguggcccuggcccucugcguguucuucauccugugcugcaccgggugcggcaccaacugcauggggaagcugaagugcaaccgcugcugcgaccgcuacgaggaguacgaccucgagccccacaagguccacgugcacuga

SEQ ID NO: 356 - RNA, 4062 nt, Artificial Sequence
  derived and/or modified CDS sequence (opt1) from MERS-CoV__ALJ54488__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacaucuacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccagcgccucgacgugcuggagcaggacgcgcagaucgaccggcugaucaacgggcgccucaccacccugaacgccuucgucgcccagcagcuggugcggagcgaguccgccgcgcucagcgcccagcuggccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccggaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 357 - RNA, 4062 nt, Artificial Sequence
  derived and/or modified CDS sequence (opt1) from MERS-CoV__ALJ54490__S
augauccacagcguguuccugcucauguuccugcugacccccaccgaguccuacgucgacgugggcccggacagcgugaaguccgccugcaucgccgucgacauccagcagacguucuucgacaagaccuggccccgccccaucgacgugagcaaggcggacgggaucaucuacccccagggccggaccuacuccaacaucaccaucacguaccagggccucuucccguaccagggcgaccacggggacauguacguguacagcgccggccacgccaccggcaccacgccccagaagcuguucgucgccaacuacucccaggacgugaagcaguucgccaacggguucgugguccgcaucggcgcggccgccaacagcaccgggaccgugaucaucucccccagcaccuccgccaccauccggaagaucuaccccgcguucaugcugggcagcuccguggggaacuucagcgacggcaagaugggccgcuucuucaaccacacgcucguccugcugccggacgggugcggcacccuccugcgggccuucuacugcauccuggagccccgcuccgggaaccacugccccgccggcaacagcuacaccuccuucgccaccuaccacacgcccgccaccgacugcagcgacggcaacuacaaccggaacgcgucccucaacagcuucaaggaguacuucaaccugcgcaacugcaccuucauguacaccuacaacaucacggaggacgagauccuggagugguucgggaucacccagaccgcccagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgcguucuacguguacaagcuccagccccugaccuuccugcucgacuucagcguggacggguacauccgccgggccaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgcgaucgccuccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgggcgcaccgaggucccccagcuggugaacgccaaccaguacagccccugcguguccaucguccccagcacggugugggaggacggcgacuacuaccggaagcagcucagcccgcuggagggcgggggcuggcugguggcguccgggagcaccgucgccaugaccgagcagcuccagaugggcuucgggaucaccgugcaguacggcaccgacacgaacuccgugugccccaagcuggaguucgccaacgacaccaagaucgccagccagcugggcaacugcgucgaguacucccucuacggggugagcggccgcgggguguuccagaacugcaccgcggucggcgugcggcagcagcgcuucguguacgacgccuaccagaaccuggucggcuacuacuccgacgacgggaacuacuacugccugcgggccugcgugagcgugcccgucuccgugaucuacgacaaggagaccaagacgcacgccacccuguucggcagcguggccugcgagcacaucuccagcaccaugucccaguacagccgcuccacccgcagcaugcucaagcggcgcgacuccacguacgggccgcugcagacccccgucggcugcgugcuggggcucgugaacagcucccuguucgucgaggacugcaagcugccccucggccagagccugugcgcgcugcccgacaccccgagcacccucaagccccgguccgugcgcagcgugcccggcgagaugcggcuggccuccaucgccuucaaccaccccauccaggucgaccagcugaacagcuccuacuucaagcucagcaucccgacgaacuucuccuucggggugacccaggaguacauccagaccaccauccagaaggugacggucgacugcaagcaguacgugugcaacggcuuccagaagugcgagcagcugcugcgcgaguacgggcaguucugcagcaagaucaaccaggcccuccacggcgccaaccugcggcaggacgacuccgugcgcaaccuguucgcgagcgucaaguccagccaguccagccccaucauccccggguucggcggcgacuucaaccucacccugcuggagcccguguccaucagcaccgggucccggagcgcccgcuccgccaucgaggaccuccuguucgacaaggugaccaucgccgacccgggcuacaugcagggguacgacgacugcaugcagcagggccccgccagcgcgcgggaccugaucugcgcccaguacgucgccggguacaaggugcucccgccccugauggacgugaacauggaggccgcguacacgagcucccugcucggcagcaucgccggcgucggguggaccgccggccuguccagcuucgccgccauccccuucgcgcaguccaucuucuaccgccugaacggggugggcaucacccagcagguccucagcgagaaccagaagcugaucgccaacaaguucaaccaggcccugggggccaugcagaccggcuucacgaccaccaacgaggccuuccggaaggugcaggacgcggugaacaacaacgcccaggcccucuccaagcuggccagcgagcuguccaacaccuucggcgccaucagcgcguccaucggggacaucauccagcgccucgacgugcuggagcaggacgcccagaucgaccggcugaucaacggccgccucacgacccugaacgccuucgucgcccagcagcuggugcggagcgaguccgcggcccucagcgcccagcuggccaaggacaaggugaacgagugcgucaaggcccaguccaagcgcagcggguucugcggccagggcacccacaucguguccuucgucgugaacgcgcccaacgggcuguacuucaugcacgugggcuacuaccccagcaaccacaucgaggucguguccgccuacgggcucugcgacgccgccaaccccaccaacugcaucgccccggugaacggcuacuucaucaagacgaacaacacccggaucgucgacgaguggagcuacaccgggagcuccuucuacgcgcccgagcccaucaccagccugaacacgaaguacguggcgccccaggugaccuaccagaacaucuccaccaaccugccgccgccccuccugggcaacagcaccggcaucgacuuccaggacgagcuggacgaguucuucaagaacgucuccaccagcauccccaacuucgggucccucacgcagaucaacaccacccugcuggaccucaccuacgagaugcugagccugcagcaggucgugaaggcccucaacgaguccuacaucgaccugaaggagcugggcaacuacacguacuacaacaaguggcccugguacaucuggcucggguucaucgccggccugguggcccuggcccucugcguguucuucauccugugcugcaccgggugcggcaccaacugcaugggcaagcugaagugcaaccgcugcugcgaccgcuacgaggaguacgaccucgagccccacaaggugcacguccacuga

SEQ ID NO: 358 - RNA, 4062 nt, Artificial Sequence
  derived and/or modified CDS sequence (opt1) from MERS-CoV__ALJ54495__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggucuccggcagcaccguggccaugaccgagcagcuccagaugggguucggcaucaccgugcaguacgggaccgacacgaacuccgucugccccaagcuggaguucgcgaacgacaccaagaucgccagccagcugggcaacugcguggaguacucccucuacggcgugagcgggcgcggcgucuuccagaacugcaccgccgugggggugcggcagcagcgcuucgucuacgacgccuaccagaaccuggugggcuacuacuccgacgacggcaacuacuacugccugcgggcgugcgugagcguccccguguccgugaucuacgacaaggagaccaagacgcacgccacccuguucgggagcgucgccugcgagcacaucuccagcaccaugucccaguacagccgcuccacccgcagcaugcucaagcggcgcgacuccacguacggcccgcugcagacccccguggggugcgugcugggccucgucaacagcucccuguucguggaggacugcaagcugccccucgggcagagccugugcgcccugcccgacaccccgagcacccucacgccccgguccgugcgcagcguccccggcgagaugcggcuggccuccaucgcguucaaccaccccauccagguggaccagcugaacagcuccuacuucaagcucagcaucccgaccaacuucuccuucggcgugacccaggaguacauccagaccacgauccagaaggucaccguggacugcaagcaguacgugugcaacggguuccagaagugcgagcagcugcugcgcgaguacggccaguucugcagcaagaucaaccaggcccuccacggggccaaccugcggcaggacgacuccguccgcaaccuguucgccagcgugaaguccagccaguccagccccaucauccccggcuucgggggcgacuucaaccucacccugcuggagcccguguccaucagcaccggcucccggagcgcccgcuccgcgaucgaggaccuccuguucgacaaggucacgaucgccgacccgggguacaugcagggcuacgacgacugcaugcagcaggggcccgccagcgcccgggaccugaucugcgcccaguacguggcgggcuacaaggugcucccgccccugauggacgucaacauggaggccgccuacaccagcucccugcucgggagcaucgccggcgugggcuggaccgcggggcuguccagcuucgccgccauccccuucgcccaguccaucuucuaccgccugaacggcguggggaucacccagcagguccucagcgagaaccagaagcugaucgccaacaaguucaaccaggcgcugggcgccaugcagacgggguucaccaccaccaacgaggccuuccggaaggugcaggacgccgugaacaacaacgcccaggcgcucuccaagcuggccagcgagcuguccaacacguucggcgccaucagcgccuccaucggcgacaucauccagcgccucgacguccuggagcaggacgcccagaucgaccggcugaucaacgggcgccucaccacccugaacgcguucguggcccagcagcuggugcggagcgaguccgccgcccucagcgcgcagcuggccaaggacaaggucaacgagugcgugaaggcccaguccaagcgcagcggcuucugcgggcagggcauccacaucgucuccuucguggugaacgcccccaacggccuguacuucaugcacgucggguacuaccccagcaaccacaucgaggugguguccgccuacggccucugcgacgcggccaaccccaccaacugcaucgccccggucaacggguacuucaucaagacgaacaacacccggaucguggacgaguggagcuacaccggcagcuccuucuacgcccccgagcccaucaccagccugaacacgaaguacguggcgccccaggucaccuaccagaacaucuccaccaaccugccgccgccccuccuggggaacagcaccggcaucgacuuccaggacgagcuggacgaguucuucaagaacguguccaccagcauccccaacuucggcucccucacgcagaucaacaccacccugcuggaccucaccuacgagaugcugagccugcagcaggucgugaaggcccucaacgaguccuacaucgaccugaaggagcuggggaacuacacguacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaagguccacgugcacuga

SEQ ID NO: 359 - RNA, 4062 nt, Artificial Sequence
  derived and/or modified CDS sequence (opt1) from MERS-CoV__ALJ54496__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccgcugaaguacuccuacaucaacaagugcagccggcuccccuccgacgaccgcaccgaggucccccagcuggugaacgccaaccaguacagccccugcguguccaucgucccgagcacggugugggaggacggggacuacuaccggaagcagcugagcccccucgagggcggcggguggcugguggccuccggcagcaccgucgcgaugaccgagcagcugcagaugggguucggcaucaccgugcaguacgggaccgacacgaacuccgugugccccaagcucgaguucgccaacgacaccaagaucgccagccagcugggcaacugcgucgaguacucccuguacggcgugagcgggcgcggcguguuccagaacugcaccgccgucggggugcggcagcagcgcuucguguacgacgcguaccagaaccucgucggcuacuacuccgacgacggcaacuacuacugccugcgggccugcgugagcgugccggucuccgugaucuacgacaaggagaccaagacgcacgccacccuguucgggagcguggccugcgagcacaucuccagcaccaugucccaguacagccgcuccacccgcagcaugcugaagcggcgcgacuccacguacggcccccuccagacccccgucgggugcgugcugggccuggugaacagcucccucuucgucgaggacugcaagcugccccuggggcagagccucugcgcccugccggacacccccagcacccugacgccccgguccgugcgcagcgugcccggcgagaugcggcucgcguccaucgccuucaaccacccgauccaggucgaccagcugaacagcuccuacuucaagcugagcauccccaccaacuucuccuucggcgugacccaggaguacauccagaccacgauccagaaggugaccgucgacugcaagcaguacgugugcaacggguuccagaagugcgagcagcuccugcgcgaguacggccaguucugcagcaagaucaaccaggcccugcacggggccaaccuccggcaggacgacuccgugcgcaaccuguucgccagcgucaaguccagccaguccagccccaucauccccggcuucgggggcgacuucaaccugacccuccuggagccgguguccaucagcaccggcucccggagcgcgcgcuccgccaucgaggaccuccuguucgacaaggugacgaucgccgaccccggguacaugcagggcuacgacgacugcaugcagcaggggcccgccagcgcccgggaccugaucugcgcgcaguacgucgccggcuacaaggugcugcccccgcucauggacgugaacauggaggccgccuacaccagcucccugcuggggagcaucgcgggcgucggcuggaccgccgggcucuccagcuucgccgccauccccuucgcccaguccaucuucuaccgccugaacggcguggggaucacccagcagguccugagcgagaaccagaagcucaucgcgaacaaguucaaccaggcccugggcgccaugcagacgggguucaccaccaccaacgaggccuuccggaaggugcaggacgccgugaacaacaacgcgcaggcccuguccaagcucgccagcgagcuguccaacacguucggcgccaucagcgccuccaucggcgacaucauccagcgccuggacgugcucgagcaggacgcgcagaucgaccggcugaucaacgggcgccugaccacccucaacgccuucgucgcccagcagcuggugcggagcgaguccgccgcgcugagcgcccagcucgccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccugugcgacgccgccaacccgacgaacugcaucgcccccgugaacggguacuucaucaagaccaacaacacccggaucgucgacgacuggagcuacaccggcagcuccuucuacgcccccgagcccaucacgagccucaacaccaaguacguggcgccccaggugaccuaccagaacaucuccaccaaccugcccccgccccugcucgggaacagcaccggcaucgacuuccaggacgagcuggacgaguucuucaagaacgucuccacgagcauccccaacuucggcucccugacccagaucaacaccacccuccuggaccugacguacgagaugcucagccugcagcaggucgugaaggcccugaacgaguccuacaucgaccucaaggagcuggggaacuacaccuacuacaacaaguggcccugguacaucuggcugggcuucaucgccgggcucguggcccuggcccugugcguguucuucauccucugcugcaccggcugcgggaccaacugcaugggcaagcugaagugcaaccgcugcugcgaccgcuacgaggaguacgaccuggagccccacaaggugcacguccacuga

SEQ ID NO: 360 - RNA, 4062 nt, Artificial Sequence
  derived and/or modified CDS sequence (opt1) from MERS-CoV__ALJ54500__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggggaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagccuccugcuguccgggaccccgccccaggucuacaacuucaagcgccucguguucaccaacugcaacuacaaccugacgaagcugcucagccuguucuccgucaacgacuucacgugcagccagaucagccccgccgccaucgcguccaacugcuacagcucccugauccucgacuacuucagcuacccccuguccaugaaguccgaccugagcgugagcuccgccggcccgaucagccaguucaacuacaagcaguccuucagcaacccgaccugccucauccuggccaccgugccccacaaccugaccaccaucaccaagccccucaaguacuccuacaucaacaagugcagccggcugcuguccgacgaccgcaccgaggucccccagcucgugaacgccaaccaguacagccccugcguguccaucguccccagcacggugugggaggacggggacuacuaccggaagcagcugagcccccuggagggcggcggguggcucguggccuccggcagcaccgucgcgaugaccgagcagcugcagaugggguucggcaucaccgugcaguacgggaccgacacgaacuccgugugcccgaagcuggaguucgccaacgacaccaagaucgccagccagcucggcaacugcgucgaguacucccuguacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccucuucgggagcguggccugcgagcacaucuccagcaccaugucccaguacagccgcuccacccgcagcaugcugaagcggcgcgacuccacguacggcccccugcagaccccggucgggugcgugcucggccuggugaacagcucccuguucgucgaggacugcaagcucccccuggggcagagccugugcgcccuccccgacacccccagcacccugacgccgcgguccgugcgcagcgugcccggcgagaugcggcuggcguccaucgccuucaaccaccccauccaggucgaccagcucaacagcuccuacuucaagcugagcauccccaccaacuucuccuucggcgugacccaggaguacauccagaccacgauccagaaggugaccgucgacugcaagcaguacgugugcaacggguuccagaagugcgagcagcugcuccgcgaguacggccaguucugcagcaagaucaaccaggcccugcacggggccaaccugcggcaggacgacuccgugcgcaaccucuucgccagcgucaaguccagccaguccagcccgaucauccccggcuucgggggcgacuucaaccugacccugcucgagcccguguccaucagcaccggcucccggagcgcgcgcuccgccaucgaggaccugcuguucgacaaggugacgaucgccgaccccggguacaugcagggcuacgacgacugcaugcagcaggggccggccagcgcccgggaccucaucugcgcgcaguacgucgccggcuacaaggugcugccgccccugauggacgugaacauggaggccgccuacaccagcucccuccuggggagcaucgcgggcgucggcuggaccgccgggcuguccagcuucgccgccauccccuucgcccaguccaucuucuaccgccucaacggcguggggaucacccagcagguccugagcgagaaccagaagcugaucgcgaacaaguucaaccaggcccucggcgccaugcagacgggguucaccaccaccaacgaggccuuccggaaggugcaggacgccgugaacaacaacgcgcaggcccuguccaagcuggccagcgagcucuccaacacguucggcgccaucagcgccuccaucggcgacaucauccagcgccuggacgugcuggagcaggacgcgcagaucgaccggcucaucaacgggcgccugaccacccugaacgccuucgucgcccagcagcucgugcggagcgaguccgccgcgcugagcgcccagcuggccaaggacaaggugaacgagugcgucaaggcccaguccaagcgcagcggcuucugcgggcagggcacccacaucguguccuucgucgugaacgcccccaacggccucuacuucaugcacgugggguacuaccccagcaaccacaucgaggucguguccgcguacggccugugcgacgccgccaaccccacgaacugcaucgcccccgugaacggguacuucaucaagaccaacaacacccggaucgucgacgaguggagcuacaccggcagcuccuucuacgccccggagcccaucacgagccugaacaccaaguacguggcgccccaggugaccuaccagaacaucuccaccaaccugcccccgccccuccuggggaacagcaccggcaucgacuuccaggacgagcucgacgaguucuucaagaacgucuccacgagcauccccaacuucggcucccugacccagaucaacaccacccugcucgaccugacguacgagaugcugagccuccagcaggucgugaaggcccugaacgaguccuacaucgaccugaaggagcucgggaacuacaccuacuacaacaaguggccgugguacaucuggcugggcuucaucgccgggcugguggcccucgcccugugcguguucuucauccugugcugcaccggcugcgggaccaacugcaugggcaagcucaagugcaaccgcugcugcgaccgcuacgaggaguacgaccuggagccccacaaggugcacguccacuga

SEQ ID NO: 361 - RNA, 4062 nt, Artificial Sequence
  derived and/or modified CDS sequence (opt1) from MERS-CoV__ALJ54501__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggggaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccggccccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacgcucugggaggacggggacuacuaccggaagcagcugagcccgcuggagggcggcggguggcucguggccuccggcagcaccguggcgaugaccgagcagcugcagaugggguucggcaucaccguccaguacgggaccgacacgaacuccgugugccccaagcuggaguucgccaacgacaccaagaucgccagccagcucggcaacugcguggaguacucccuguacggcgucagcgggcgcggcguguuccagaacugcaccgccguggggguccggcagcagcgcuucguguacgacgcguaccagaaccuggugggcuacuacuccgacgacggcaacuacuacugccugcgggccugcgucagcgugcccguguccgucaucuacgacaaggagaccaagacgcacgccacccucuucgggagcguggccugcgagcacaucuccagcaccaugucccaguacagccgcuccacccgcagcaugcugaagcggcgcgacuccacguacggcccgcugcagacccccguggggugcguccucggccuggugaacagcucccuguucguggaggacugcaagcucccccuggggcagagccugugcgcccuccccgacaccccgagcacccugacgccccgguccguccgcagcgugcccggcgagaugcggcuggcguccaucgccuucaaccaccccauccagguggaccagcucaacagcuccuacuucaagcugagcaucccgaccaacuucuccuucggcgucacccaggaguacauccagaccacgauccagaaggugaccguggacugcaagcaguacgucugcaacggguuccagaagugcgagcagcugcuccgcgaguacggccaguucugcagcaagaucaaccaggcccugcacggggccaaccugcggcaggacgacuccgugcgcaaccucuucgccagcgugaaguccagccaguccagccccaucauccccggcuucgggggcgacuucaaccugacccugcucgagcccgucuccaucagcaccggcucccggagcgcgcgcuccgccaucgaggaccugcuguucgacaaggugacgaucgccgacccgggguacaugcagggcuacgacgacugcaugcagcaggggcccgccagcgcccgggaccucaucugcgcgcaguacguggccggcuacaagguccugccgccccugauggacgugaacauggaggccgccuacaccagcucccuccuggggagcaucgcgggcgugggcuggaccgccgggcuguccagcuucgccgccauccccuucgcccaguccaucuucuaccgccucaacggcgucgggaucacccagcagguccugagcgagaaccagaagcugaucgcgaacaaguucaaccaggcccucggcgccaugcagacgggguucaccaccaccaacgaggccuuccggaaggugcaggacgccgugaacaacaacgcgcaggcccuguccaagcuggccagcgagcucuccaacacguucggcgccaucagcgccuccaucggcgacaucauccagcgccuggacgugcuggagcaggacgcgcagaucgaccggcucaucaacgggcgccugaccacccugaacgccuucguggcccagcagcucguccggagcgaguccgccgcgcugagcgcccagcuggccaaggacaaggugaacgagugcgugaaggcccaguccaagcgcagcggcuucugcgggcagggcacccacaucgucuccuucguggucaacgcccccaacggccucuacuucaugcacgugggguacuaccccagcaaccacaucgagguggucuccgcguacggccugugcgacgccgccaaccccacgaacugcaucgccccggugaacggguacuucaucaagaccaacaacacccggaucguggacgaguggagcuacaccggcagcuccuucuacgcccccgagcccaucacgagccugaacaccaaguacgucgcgccccaggugaccuaccagaacaucuccaccaaccucccgccgccccugcuggggaacagcaccggcaucgacuuccaggacgagcucgacgaguucuucaagaacguguccacgagcauccccaacuucggcucccugacccagaucaacaccacccugcucgaccugacguacgagaugcugagccuccagcaggucgugaaggcccugaacgaguccuacaucgaccugaaggagcucgggaacuacaccuacuacaacaaguggcccugguacaucuggcugggcuucaucgccgggcugguggcccucgcccugugcgucuucuucauccugugcugcaccggcugcgggaccaacugcaugggcaagcucaagugcaaccgcugcugcgaccgcuacgaggaguacgaccuggagccccacaaggugcacgugcacuga

SEQ ID NO: 362 - RNA, 4062 nt, Artificial Sequence
  derived and/or modified CDS sequence (opt1) from MERS-CoV__ALJ54502__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcguccgggaccugaucugcgcccaguacguggcgggcuacaaggugcucccgccccugauggacgucaacauggaggccgccuacaccagcucccugcucgggagcaucgccggcgugggcuggaccgcggggcuguccagcuucgccgccauccccuucgcccaguccaucuucuaccgccugaacggcguggggaucacccagcagguccucagcgagaaccagaagcugaucgccaacaaguucaaccaggcgcugggcgccaugcagacgggguucaccaccaccaacgaggccuuccggaaggugcaggacgccgugaacaacaacgcccaggcgcucuccaagcuggccagcgagcuguccaacacguucggcgccaucagcgccuccaucggcgacaucauccagcgccucgacguccuggagcaggacgcccagaucgaccggcugaucaacgggcgccucaccacccugaacgcguucguggcccagcagcuggugcggagcgaguccgccgcccucagcgcgcagcuggccaaggacaaggucaacgagugcgugaaggcccaguccaagcgcagcggcuucugcgggcagggcacccacaucgucuccuucguggugaacgcccccaacggccuguacuucaugcacgucggguacuaccccagcaaccacaucgaggugguguccgccuacggccucugcgacgcggccaaccccacgaacugcaucgccccggucaacggguacuucaucaagaccaacaacacccggaucguggacgaguggagcuacaccggcagcuccuucuacgcccccgagcccaucacgagccugaacaccaaguacguggcgccccaggucaccuaccagaacaucuccaccaaccugccgccgccccuccuggggaacagcaccggcaucgacuuccaggacgagcuggacgaguucuucaagaacguguccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaaguucaaccgcugcugcgaccgcuacgaggaguacgaccucgagccccacaagguccacgugcacuga

SEQ ID NO: 363 - RNA, 4062 nt, Artificial Sequence
  derived and/or modified CDS sequence (opt1) from MERS-CoV__ALJ54512__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgcccaccucuucagcucccgguacguggaccuguacgggggcaacauguuccaguucgccacccugccgguguacgacacgaucaaguacuacagcaucaucccccacuccauccgcagcauccaguccgaccggaaggccugggccgcguucuacgucuacaagcuccagccccugaccuuccugcucgacuucagcguggacggguacauccgccgggccaucgacugcggcuucaacgaccugucccagcugcacugcagcuacgaguccuucgacguggagagcggcgucuacuccgugagcuccuucgaggccaagcccagcggguccguggucgagcaggccgagggcguggagugcgacuucagcccgcuccuguccgggaccccgccccagguguacaacuucaagcgccuggucuucaccaacugcaacuacaaccucacgaagcugcugagccucuucuccgugaacgacuucacgugcagccagaucagccccgccgcgaucgccuccaacugcuacagcucccugauccuggacuacuucagcuacccccucuccaugaaguccgaccugagcgucagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggugccccagcuggucaacgccaaccaguacagccccugcguguccaucgugcccagcacggucugggaggacggggacuacuaccggaagcagcucagcccgcuggagggcggcggguggcugguggcguccggcagcaccguggccaugaccgagcagcuccagaugggguucggcaucaccguccaguacgggaccgacacgaacuccgugugccccaagcuggaguucgccaacgacaccaagaucgccagccagcugggcaacugcguggaguacucccucuacggcgucagcgggcgcggcguguuccagaacugcaccgcgguggggguccggcagcagcgcuucguguacgacgccuaccagaaccuggugggcuacuacuccgacgacggcaacuacuacugccugcgggccugcgucagcgugcccguguccgucaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccguggggugcguccugggccucgugaacagcucccuguucguggaggacugcaagcugccccucgggcagagccugugcgcgcugcccgacaccccgagcacccucacgccccgguccguccgcagcgugcccggcgagaugcggcuggccuccaucgccuucaaccaccccauccagguggaccagcugaacagcuccuacuucaagcucagcaucccgaccaacuucuccuucggcgucacccaggaguacauccagaccacgauccagaaggugaccguggacugcaagcaguacgucugcaacggguuccagaagugcgagcagcugcugcgcgaguacggccaguucugcagcaagaucaaccaggcccuccacggggccaaccugcggcaggacgacuccgugcgcaaccuguucgcgagcgugaaguccagccaguccagccccaucauccccggcuucgggggcgacuucaaccucacccugcuggagcccgucuccaucagcaccggcucccggagcgcccgcuccgccaucgaggaccuccuguucgacaaggugacgaucgccgacccgggguacaugcagggcuacgacgacugcaugcagcaggggcccgccagcgcgcgggaccugaucugcgcccaguacguggccggcuacaagguccucccgccccugauggacgugaacauggaggccgcguacaccagcucccugcucgggagcaucgccggcgugggcuggaccgccgggcuguccagcuucgccgccauccccuucgcgcaguccaucuucuaccgccugaacggcgucgggaucacccagcagguccucagcgagaaccagaagcugaucgccaacaaguucaaccaggcccugggcgccaugcagacgggguucaccaccaccaacgaggccuuccggaaggugcaggacgcggugaacaacaacgcccaggcccucuccaagcuggccagcgagcuguccaacacguucggcgccaucagcgcguccaucggcgacaucauccagcgccucgacgugcuggagcaggacgcccagaucgaccggcugaucaacgggcgccucaccacccugaacgccuucguggcccagcagcugguccggagcgaguccgcggcccucagcgcccagcuggccaaggacaaggugaacgagugcgugaaggcccaguccaagcgcagcggcuucugcgggcagggcacccacaucgucuccuucguggucaacgcgcccaacggccuguacuucaugcacgugggguacuaccccagcaaccacaucgagguggucuccgccuacggccucugcgacgccgccaaccccacgaacugcaucgccccggugaacggguacuucaucaagaccaacaacacccggaucguggacgaguggagcuacaccggcagcuccuucuacgcgcccgagcccaucacgagccugaacaccaaguacgucgcgccccaggugaccuaccagaacaucuccaccaaccugccgccgccccuccuggggaacagcaccggcaucgacuuccaggacgagcuggacgaguucuucaagaacguguccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcgucuucuucauccugugcugcaccggcugcgggaccaacugcaugggcaagcugaagugcaaccgcugcugcgaccgcuacgaggaguacgaccucgagccccacaaggugcacgugcacuga

SEQ ID NO: 364 - RNA, 4062 nt, Artificial Sequence
  derived and/or modified CDS sequence (opt1) from MERS-CoV__ALJ54517__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacgggaacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccagcgccucgacgugcuggagcaggacgcgcagaucgaccggcugaucaacgggcgccucaccacccugaacgccuucgucgcccagcagcuggugcggagcgaguccgccgcgcucagcgcccagcuggccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccggaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcacccgcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcugggcaacuacaccuacuacaacaaguggcccugguacaucuggcucggguucaucgccggccugguggcccuggcccucugcguguucuucauccugugcugcaccgggugcggcaccaacugcauggggaagcugaagugcaaccgcugcugcgaccgguacgaggaguacgaccucgagccccacaaggugcacguccacuga

SEQ ID NO: 365 - RNA, 4062 nt, Artificial Sequence
  derived and/or modified CDS sequence (opt1) from MERS-CoV__ALJ54518__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccgcugaaguacuccuacaucaacaagugcagccggcuccccuccgacgaccgcaccgaggucccccagcuggugaacgccaaccaguacagccccugcguguccaucgucccgagcacggugugggaggacggggacuacuaccggaagcagcugagcccccucgagggcggcggguggcugguggccuccggcagcaccgucgcgaugaccgagcagcugcagaugggguucggcaucaccgugcaguacgggaccgacacgaacuccgugugccccaagcucgaguucgccaacgacaccaagaucgccagccagcugggcaacugcgucgaguacucccuguacggcgugagcgggcgcggcguguuccagaacugcaccgccgucggggugcggcagcagcgcuucguguacgacgcguaccagaaccucgucggcuacuacuccgacgacggcaacuacuacugccugcgggccugcgugagcgugccggucuccgugaucuacgacaaggagaccaagacgcacgccacccuguucgggagcguggccugcgagcacaucuccagcaccaugucccaguacagccgcuccacccgcagcaugcugaagcggcgcgacuccacguacggcccccuccagacccccgucgggugcgugcugggccuggugaacagcucccucuucgucgaggacugcaagcugccccuggggcagagccucugcgcccugccggacacccccagcacccugacgccccgguccgugcgcagcgugcccggcgagaugcggcucgcguccaucgccuucaaccacccgauccaggucgaccagcugaacagcuccuacuucaagcugagcauccccaccaacuucuccuucggcgugacccaggaguacauccagaccacgauccagaaggugaccgucgacugcaagcaguacgugugcaacggguuccagaagugcgagcagcuccugcgcgaguacggccaguucugcagcaagaucaaccaggcccugcacggggccaaccuccggcaggacgacuccgugcgcaaccuguucgccagcgucaaguccagccaguccagccccaucauccccggcuucgggggcgacuucaaccugacccuccuggagccgguguccaucagcaccggcucccggagcgcgcgcuccgccaucgaggaccuccuguucgacaaggugacgaucgccgaccccggguacaugcagggcuacgacgacugcaugcagcaggggcccgccagcgcccgggaccugaucugcgcgcaguacgucgccggcuacaaggugcugcccccgcucauggacgugaacauggaggccgccuacaccagcucccugcuggggagcaucgcgggcgucggcuggaccgccgggcucuccagcuucgccgccauccccuucgcccaguccaucuucuaccgccugaacggcguggggaucacccagcagguccugagcgagaaccagaagcucaucgcgaacaaguucaaccaggcccugggcgccaugcagacgggguucaccaccaccaacgaggccuuccggaaggugcaggacgccgugaacaacaacgcgcaggcccuguccaagcucgccagcgagcuguccaacacguucggcgccaucagcgccuccaucggcgacaucauccagcgccuggacgugcucgagcaggacgcgcagaucgaccggcugaucaacgggcgccugaccacccucaacgccuucgucgcccagcagcuggugcggagcgaguccgccgcgcugagcgcccagcucgccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccugugcgacgccgccaacccgacgaacugcaucgcccccgugaacggguacuucaucaagaccaacaacacccggaucgucgacgaguggagcuacaccggcagcuccuucuacgcccccgagcccaucacgagccucaacaccaaguacguggcgccccaggugaccuaccagaacaucuccaccaaccugcccccgccccugcucgggaacagcaccggcaucgacuuccaggacgagcuggacgaguucuucaagaacgucuccacgagcauccccaacuucggcucccugacccagaucaacaccacccuccuggaccugacguacgagaugcucagccugcagcaggucgugaaggcccugaacgaguccuacaucgaccucaaggagcuggggaacuacaccuacuacaacaaguggcccugguacaucuggcugggcuucaucgccgggcucguggcccuggcccugugcguguucuucauccucugcugcaccggcugcgggaccaacugcaugggcaagcugaagugcaaccgcugcugcgaccgcuacgaggaguacgaccuggagccccacaaggugcacguccacuga

SEQ ID NO: 366 - RNA, 4062 nt, Artificial Sequence
  derived and/or modified CDS sequence (opt1) from MERS-CoV__ALW82691__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccgcuccgacgaccggaccgaggucccccagcuggugaacgccaaccaguacagccccugcguguccaucguccccagcacggugugggaggacggggacuacuaccgcaagcagcugagcccgcucgagggcggcggguggcugguggccuccggcagcaccgucgcgaugaccgagcagcugcagaugggguucggcaucaccgugcaguacgggaccgacacgaacuccgugugccccaagcucgaguucgccaacgacaccaagaucgccagccagcugggcaacugcgucgaguacucccuguacggcgugagcgggcggggcguguuccagaacugcaccgccgucggggugcgccagcagcgguucguguacgacgcguaccagaaccucgucggcuacuacuccgacgacggcaacuacuacugccugcgcgccugcgugagcgugcccgucuccgugaucuacgacaaggagaccaagacgcacgccacccuguucgggagcguggccugcgagcacaucuccagcaccaugucccaguacagccgcuccacccggagcaugcugaagcgccgggacuccacguacggcccgcuccagacccccgucgggugcgugcugggccuggugaacagcucccucuucgucgaggacugcaagcugccccuggggcagagccucugcgcccugcccgacaccccgagcacccugacgccccgcuccgugcggagcgugcccggcgagaugcgccucgcguccaucgccuucaaccaccccauccaggucgaccagcugaacagcuccuacuucaagcugagcaucccgaccaacuucuccuucggcgugacccaggaguacauccagaccacgauccagaaggugaccgucgacugcaagcaguacgugugcaacggguuccagaagugcgagcagcuccugcgggaguacggccaguucugcagcaagaucaaccaggcccugcacggggccaaccuccgccaggacgacuccgugcggaaccuguucgccagcgucaaguccagccaguccagccccaucauccccggcuucgggggcgacuucaaccugacccuccuggagcccguguccaucagcaccggcucccgcagcgcgcgguccgccaucgaggaccuccuguucgacaaggugacgaucgccgacccgggguacaugcagggcuacgacgacugcaugcagcaggggcccgccagcgcccgcgaccugaucugcgcgcaguacgucgccggcuacaaggugcugccgccccucauggacgugaacauggaggccgccuacaccagcucccugcuggggagcaucgcgggcgucggcuggaccgccgggcucuccagcuucgccgccauccccuucgcccaguccaucuucuaccggcugaacggcguggggaucacccagcagguccugagcgagaaccagaagcucaucgcgaacaaguucaaccaggcccugggcgccaugcagacgggguucaccaccaccaacgaggccuuccgcaaggugcaggacgccgugaacaacaacgcgcaggcccuguccaagcucgccagcgagcuguccaacacguucggcgccaucagcgccuccaucggcgacaucauccagcggcuggacgugcucgagcaggacgcgcagaucgaccgccugaucaacgggcggcugaccacccucaacgccuucgucgcccagcagcuggugcgcagcgaguccgccgcgcugagcgcccagcucgccaaggacaaggugaacgagugcgucaaggcccaguccaagcggagcggcuucugcgggcagggcacccacaucguguccuucgucgugaacgcccccaacggccuguacuucaugcacgugggguacuaccccagcaaccacaucgaggucguguccgcguacggccugugcgacgccgccaaccccacgaacugcaucgccccggugaacggguacuucaucaagaccaacaacacccgcaucgucgacgaguggagcuacaccggcagcuccuucuacgcccccgagcccaucacgagccucaacaccaaguacguggcgccccaggugaccuaccagaacaucuccaccaaccugccgccgccccugcucgggaacagcaccggcaucgacuuccaggacgagcuggacgaguucuucaagaacgucuccacgagcauccccaacuucggcucccugacccagaucaacaccacccuccuggaccugacguacgagaugcucagccugcagcaggucgugaaggcccugaacgaguccuacaucgaccucaaggagcuggggaacuacaccuacuacaacaaguggcccugguacaucuggcugggcuucaucgccgggcucguggcccuggcccugugcguguucuucauccucugcugcaccggcugcgggaccaacugcaugggcaagcugaagugcaaccgcugcugcgaccgguacgaggaguacgaccuggagccccacaaggugcacguccacuga

SEQ ID NO: 367 - RNA, 4062 nt, Artificial Sequence
  derived and/or modified CDS sequence (opt1) from MERS-CoV__ALW82742__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccagaagaucuaccccgccuucaugcugggcagcuccguggggaacuucagcgacggcaagaugggccgguucuucaaccacacgcucguccugcugccggacgggugcggcacccuccugcgcgcguucuacugcauccuggagccccgguccgggaaccacugccccgccggcaacagcuacaccuccuucgccaccuaccacacgcccgccaccgacugcagcgacggcaacuacaaccgcaacgccucccucaacagcuucaaggaguacuucaaccugcggaacugcaccuucauguacaccuacaacaucacggaggacgagauccuggagugguucgggaucacccagaccgcgcagggcgugcaccucuucagcucccgcuacguggaccuguacgggggcaacauguuccaguucgccacccugccggucuacgacacgaucaaguacuacagcaucaucccccacuccauccggagcauccaguccgaccgcaaggccugggccgccuucuacguguacaagcuccagccccugaccuuccugcucgacuucagcguggacggguacauccggcgcgcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcggcugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccgccuccuguccgacgaccggaccgaggucccccagcuggugaacgccaaccaguacagccccugcguguccaucguccccagcacggugugggaggacggggacuacuaccgcaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcggggcguguuccagaacugcaccgccgucggggugcgccagcagcgguucguguacgacgcguaccagaaccuggucggcuacuacuccgacgacggcaacuacuacugccugcgcgccugcgugagcgugcccgucuccgugaucuacgacaaggagaccaagacgcacgccacccuguucgggagcguggccugcgagcacaucuccagcaccaugucccaguacagccgguccacccgcagcaugcucaagcgccgggacuccacguacggcccgcugcagacccccgucgggugcgugcugggccucgugaacagcucccuguucgucgaggacugcaagcugccccucgggcagagccugugcgcccugcccgacaccccgagcacccucacgccccgcuccgugcggagcgugcccggcgagaugcgccuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgggaguacggccaguucugcagcaagaucaaccaggcccuccacggggccaaccugcgccaggacgacuccgugcggaaccuguucgccagcgucaaguccagccaguccagccccaucauccccggcuucgggggcgacuucaaccucacccugcuggagcccguguccaucagcaccggcucccgcagcgcgcgguccgccaucgaggaccuccuguucgacaaggugacgaucgccgacccgggguacaugcagggcuacgacgacugcaugcagcaggggcccgccagcgcccgcgaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccggcugaacggcguggggaucacccagcagguccucagcgagaaccagaagcugaucgcgaacaaguucaaccaggcccugggcgccaugcagacgggguucaccaccaccaacgaggccuuccgcaaggugcaggacgccgugaacaacaacgcgcaggcccucuccaagcuggccagcgagcuguccaacacguucggcgccaucagcgccuccaucggcgacaucauccagcggcucgacgugcuggagcaggacgcgcagaucgaccgccugaucaacgggcggcucaccacccugaacgccuucgucgcccagcagcuggugcgcagcgaguccgccgcgcucagcgcccagcuggccaaggacaaggugaacgagugcgucaaggcccaguccaagcggagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccgcaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccggugcugcgaccgcuacgaggaguacgaccucgagccccacaaggugcacguccacuga

SEQ ID NO: 368 - RNA, 4062 nt, Artificial Sequence
  derived and/or modified CDS sequence (opt1) from MERS-CoV__ALW82753__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccagcaccgacugcuccgacggcaacuacaaccggaacgccagccucaacagcuucaaggaguacuucaaccugcgcaacugcaccuucauguacaccuacaacaucacggaggacgagauccuggagugguucgggaucacccagaccgcccagggcgugcaccucuucuccagccgguacguggaccuguacgggggcaacauguuccaguucgcgacccugccggucuacgacacgaucaaguacuacuccaucaucccccacagcauccgcuccauccagagcgaccggaaggccugggccgccuucuacguguacaagcuccagccccugaccuuccugcucgacuucuccguggacggguacauccgccgggccaucgacugcggcuucaacgaccugagccagcugcacugcuccuacgagagcuucgacgucgaguccggcguguacagcguguccagcuucgaggcgaagcccuccgggagcgucguggagcaggccgagggcguggagugcgacuucuccccgcuccugagcgggaccccgccccaggucuacaacuucaagcgccugguguucaccaacugcaacuacaaccucacgaagcugcugucccucuucagcgucaacgacuucacgugcagccagaucucccccgccgccaucgccagcaacugcuacuccagccugauccuggacuacuucuccuacccccucagcaugaaguccgaccugagcguguccagcgcggggcccaucucccaguucaacuacaagcagagcuucuccaacccgaccugccugauccucgccaccgugccccacaaccugaccaccaucaccaagccccugaaguacagcuacaucaacaagugcucccggcuccugagcgacgaccgcaccgaggucccccagcuggugaacgccaaccaguacucccccugcgugagcaucguccccagcacggugugggaggacggggacuacuaccggaagcagcucuccccgcuggagggcggcggguggcugguggccagcggcuccaccgucgccaugaccgagcagcuccagaugggguucggcaucaccgugcaguacgggaccgacacgaacagcgugugccccaagcuggaguucgcgaacgacaccaagaucgccucccagcugggcaacugcgucgaguacagccucuacggcguguccgggcgcggcguguuccagaacugcaccgccgucggggugcggcagcagcgcuucguguacgacgccuaccagaaccuggucggcuacuacagcgacgacggcaacuacuacugccugcgggcgugcguguccgugcccgucagcgugaucuacgacaaggagaccaagacgcacgccacccuguucggguccguggccugcgagcacaucagcuccaccaugagccaguacucccgcagcacccgcuccaugcucaagcggcgcgacagcacguacggcccgcugcagacccccgucgggugcgugcugggccucgugaacuccagccuguucgucgaggacugcaagcugccccucgggcagagccugugcgcccugcccgacaccccguccacccucacgccccggagcgugcgcuccgugcccggcgagaugcggcuggccagcaucgcguucaaccaccccauccaggucggccagcugaacuccagcuacuucaagcucuccaucccgaccaacuucagcuucggggugacccaggaguacauccagaccacgauccagaaggugaccgucgacugcaagcaguacgugugcaacggcuuccagaagugcgagcagcugcugcgcgaguacgggcaguucugcuccaagaucaaccaggcccuccacggcgccaaccugcggcaggacgacagcgugcgcaaccuguucgccuccgucaagagcucccagagcucccccaucauccccggguucggcggcgacuucaaccucacccugcuggagcccgugagcaucuccaccgggagccgguccgcccgcagcgcgaucgaggaccuccuguucgacaaggugacgaucgccgacccgggcuacaugcagggguacgacgacugcaugcagcagggccccgccagcgcccgggaccugaucugcgcccaguacgucgcgggguacaaggugcucccgccccugauggacgugaacauggaggccgccuacaccuccagccugcucggcuccaucgccggcgucggguggaccgcgggccugagcuccuucgccgccauccccuucgcccagagcaucuucuaccgccugaacggggugggcaucacccagcagguccucuccgagaaccagaagcugaucgccaacaaguucaaccaggcgcugggggccaugcagacgggcuucaccaccaccaacgaggccuuccggaaggugcaggacgccgugaacaacaacgcccaggcgcucagcaagcuggccuccgagcugagcaacacguucggcgccaucuccgccagcaucggggacaucauccagcgccucgacgugcuggagcaggacgcccagaucgaccggcugaucaacggccgccucaccacccugaacgcguucgucgcccagcagcuggugcgguccgagagcgccgcccucuccgcgcagcuggccaaggacaaggugaacgagugcgucaaggcccagagcaagcgcuccggguucugcggccagggcacccacaucgugagcuucgucgugaacgcccccaacgggcuguacuucaugcacgugggcuacuaccccuccaaccacaucgaggucgugagcgccuacgggcucugcgacgcggccaaccccacgaacugcaucgccccggugaacggcuacuucaucaagaccaacaacacccggaucgucgacgaguggagcuacaccggguccagcuucuacgcccccgagcccaucacgucccugaacaccaaguacguggcgccccaggugaccuaccagaacaucagcaccaaccugccgccgccccuccuguccaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 369 - RNA, 4062 nt, Artificial Sequence
  derived and/or modified CDS sequence (opt1) from MERS-CoV__ALX27228__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacgguguggaaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucagcugcgugcuggggcucgugaacuccagccuguucgucgaggacugcaagcugccccucggccagagccugugcgcccugcccgacaccccguccacccucacgccccggagcgugcgcuccgugcccggggagaugcggcuggcgagcaucgccuucaaccaccccauccaggucgaccagcugaacuccagcuacuucaagcucuccaucccgaccaacuucagcuucggcgugacccaggaguacauccagaccacgauccagaaggugaccgucgacugcaagcaguacgugugcaacggcuuccagaagugcgagcagcugcugcgcgaguacgggcaguucugcuccaagaucaaccaggcccuccacggcgccaaccugcggcaggacgacagcgugcgcaaccuguucgccuccgucaagagcucccagagcucccccaucauccccggguucggcggggacuucaaccucacccugcuggagcccgugagcaucuccaccggcagccgguccgcgcgcagcgccaucgaggaccuccuguucgacaaggugacgaucgccgacccgggcuacaugcagggguacgacgacugcaugcagcagggccccgccagcgcccgggaccugaucugcgcgcaguacgucgccggguacaaggugcucccgccccugauggacgugaacauggaggccgccuacaccuccagccugcucggcuccaucgcgggggucggcuggaccgccggccugagcuccuucgccgccauccccuucgcccagagcaucuucuaccgccugaacggggugggcaucacccagcagguccucuccgagaaccagaagcugaucgcgaacaaguucaaccaggcccugggggccaugcagacgggcuucaccaccaccaacgaggccuuccggaaggugcaggacgccgugaacaacaacgcgcaggcccucagcaagcuggccuccgagcugagcaacacguucggggccaucuccgccagcaucggcgacaucauccagcgccucgacgugcuggagcaggacgcgcagaucgaccggcugaucaacggccgccucaccacccugaacgccuucgucgcccagcagcuggugcgguccgagagcgccgcgcucuccgcccagcuggccaaggacaaggugaacgagugcgucaaggcccagagcaagcgcuccggguucugcggccaggggacccacaucgugagcuucgucgugaacgcccccaacggccuguacuucaugcacgugggcuacuaccccuccaaccacaucgaggucgugagcgcguacgggcucugcgacgccgccaaccccacgaacugcaucgccccggugaacggcuacuucaucaagaccaacaacacccggaucgucgacgaguggagcuacaccggguccagcuucuacgcccccgagcccaucacgucccugaacaccaaguacguggcgccccaggugaccuaccagaacaucagcaccaaccugccgccgccccuccugggcaacuccaccgggaucgacuuccaggacgagcuggacgaguucuucaagaacgucagcacguccauccccaacuucggcagccucacccagaucaacaccacccugcuggaccucacguacgagaugcugucccugcagcaggucgugaaggcccucaacgagagcuacaucgaccugaaggagcugggcaacuacaccuacuacaacaaguggcccugguacaucuggcucggguucaucgccggccugguggcccuggcccucugcguguucuucauccugugcugcaccgggugcggcaccaacugcauggggaagcugaagugcaaccgcugcugcgaccgcuacgaggaguacgaccucgagccccacaaggugcacguccacuga

SEQ ID NO: 370 - RNA, 4062 nt, Artificial Sequence
  derived and/or modified CDS sequence (opt1) from MERS-CoV__ALX27232__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcuacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccagcgccucgacgugcuggagcaggacgcgcagaucgaccggcugaucaacgggcgccucaccacccugaacgccuucgucgcccagcagcuggugcggagcgaguccgccgcgcucagcgcccagcuggccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgacgucguguccgcguacggccucugcgacgccgccaaccccacgaacugcaucgccccggugaacggguacuucaucaagaccaacaacacccggaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 371 - RNA, 4062 nt, Artificial Sequence
  derived and/or modified CDS sequence (opt1) from MERS-CoV__AMQ48993__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaucgucgcgaugaccgagcagcuccagaugggguucggcaucaccgugcaguacgggaccgacaccaacuccgugugccccaagcuggaguucgccaacgacacgaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacccacgccacgcuguucgggagcguggccugcgagcacaucuccagcaccaugucccaguacagccgcuccacccgcagcaugcucaagcggcgcgacuccaccuacggcccgcugcagacgcccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccaccauccagaaggugacggucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugaccaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacacgagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagaccggguucacgaccaccaacgaggccuuccggaaggugcaggacgccgugaacaacaacgcgcaggcccucuccaagcuggccagcgagcuguccaacaccuucggcgccaucagcgccuccaucggcgacaucauccagcgccucgacgugcuggagcaggacgcgcagaucgaccggcugaucaacgggcgccucacgacccugaacgccuucgucgcccagcagcuggugcggagcgaguccgccgcgcucagcgcccagcuggccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccaccaacugcaucacgccggugaacggguacuucaucaagaccaacaacacccggaucgucgacgaguggagcuacaccggcagcuccuucuacgcccccgagcccaucacgagccugaacaccaaguacguggcgccccaggugaccuaccagaacaucuccaccaaccugccgccgccccuccugagcaacuccaccgggaucgacuuccaggacgagcuggacgaguucuucaagaacgucagcacguccauccccaacuucggcagccucacccagaucaacaccacccugcuggaccucacguacgagaugcugucccugcagcaggucgugaaggcccucaacgagagcuacaucgaccugaaggagcugggcaacuacaccuacuacaacaaguggcccugguacaucuggcucggguucaucgccggccugguggcccuggcccucugcguguucuucauccugugcugcaccgggugcggcaccaacugcauggggaagcugaagugcaaccgcugcugcgaccgcuacgaggaguacgaccucgagccccacaaggugcacguccacuga

SEQ ID NO: 372 - RNA, 4062 nt, Artificial Sequence
  derived and/or modified CDS sequence (opt1) from MERS-CoV__AMW90844__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccuuccaguacgggaccgacacgaacuccgugugccccaagcuggaguucgccaacgacaccaagaucgccagccagcugggcaacugcguggaguacucccucuacggcgucagcgggcgcggcguguuccagaacugcaccgccguggggguccggcagcagcgcuucguguacgacgcguaccagaaccuggugggcuacuacuccgacgacggcaacuacuacugccugcgggccugcgucagcgugcccguguccgucaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccguggggugcguccugggccucgugaacagcucccuguucguggaggacugcaagcugccccucgggcagagccugugcgcccugcccgacaccccgagcacccucacgccccgguccguccgcagcgugcccggcgagaugcggcuggcguccaucgccuucaaccaccccauccagguggaccagcugaacagcuccuacuucaagcucagcaucccgaccaacuucuccuucggcgucacccaggaguacauccagaccacgauccagaaggugaccguggacugcaagcaguacgucugcaacggguuccagaagugcgagcagcugcugcgcgaguacggccaguucugcagcaagaucaaccaggcccuccacggggccaaccugcggcaggacgacuccgugcgcaaccuguucgccagcgugaaguccagccaguccagccccaucauccccggcuucgggggcgacuucaaccucacccugcuggagcccgucuccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacguggccggcuacaagguccucccgccccugauggacgugaacauggaggccgccuacaccagcucccugcucgggagcaucgcgggcgugggcuggaccgccgggcuguccagcuucgccgccauccccuucgcccaguccaucuucuaccgccugaacggcgucgggaucacccagcagguccucagcgagaaccagaagcugaucgcgaacaaguucaaccaggcccugggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccagcgccucgacgugcuggagcaggacgcgcagaucgaccggcugaucaacgggcgccucaccacccugaacgccuucguggcccagcagcugguccggagcgaguccgccgcgcucagcgcccagcuggccaaggacaaggugaacgagugcgugaaggcccaguccaagcgcagcggcuucugcgggcagggcacccacaucgucuccuucguggucaacgcccccaacggccuguacuucaugcacgugggguacuaccccagcaaccacaucgagguggucuccgcguacggccucugcgacgccgccaaccccacgaacugcaucgccccggugaacggguacuucaucaagaccaacaacacccggaucguggacgaguggagcuacaccggcagcuccuucuacgcccccgagcccaucacgagccugaacaccaaguacgucgcgccccaggugaccuaccagaacaucuccaccaaccugccgccgccccuccuggggaacagcaccggcaucgacuuccaggacgagcuggacgaguucuucaagaacguguccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcgucuucuucauccugugcugcaccggcugcgggaccaacugcaugggcaagcugaagugcaaccgcugcugcgaccgcuacgaggaguacgaccucgagccccacaaggugcacgugcacuga

SEQ ID NO: 373 - RNA, 4062 nt, Artificial Sequence
  derived and/or modified CDS sequence (opt1) from MERS-CoV__AMW90852__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaacuucacgaagcuccugagccuguucuccgucaacgacuucacgugcagccagaucagccccgccgccaucgcguccaacugcuacagcucccucauccuggacuacuucagcuacccccuguccaugaaguccgaccucagcgugagcuccgccgggcccaucagccaguucaacuacaagcaguccuucagcaacccgaccugccugauccuggccaccgugccccacaaccucaccaccaucaccaagccccugaaguacuccuacaucaacaagugcagccggcugcucuccgacgaccgcaccgaggucccccagcuggugaacgccaaccaguacagccccugcguguccaucguccccagcacggugugggaggacggggacuacuaccggaagcagcugagcccgcucgagggcggcggguggcugguggccuccggcagcaccgucgcgaugaccgagcagcugcagaugggguucggcaucaccgugcaguacgggaccgacacgaacuccgugugccccaagcucgaguucgccaacgacaccaagaucgccagccagcugggcaacugcgucgaguacucccuguacggcgugagcgggcgcggcguguuccagaacugcaccgccgucggggugcggcagcagcgcuucguguacgacgcguaccagaaccucgucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcugaagcggcgcgacuccacguacggcccgcuccagacccccgucgggugcgugcugggccuggugaacagcucccucuucgucgaggacugcaagcugccccuggggcagagccucugcgcccugcccgacaccccgagcacccugacgccccgguccgugcgcagcgugcccggcgagaugcggcucgcguccaucgccuucaaccaccccauccaggucgaccagcugaacagcuccuacuucaagcugagcaucccgaccaacuucuccuucggcgugacccaggaguacauccagaccacgauccagaaggugaccgucgacugcaagcaguacgugugcaacggguuccagaagugcgagcagcuccugcgcgaguacggccaguucugcagcaagaucaaccaggcccugcacggggccaaccuccggcaggacgacuccgugcgcaaccuguucgccagcgucaaguccagccaguccagccccaucauccccggcuucgggggcgacuucaaccugacccuccuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcugccgccccucauggacgugaacauggaggccgccuacaccagcucccugcuggggagcaucgcgggcgucggcuggaccgccgggcucuccagcuucgccgccauccccuucgcccaguccaucuucuaccgccugaacggcguggggaucacccagcagguccugagcgagaaccagaagcucaucgcgaacaaguucaaccaggcccugggcgccaugcagacgggguucaccaccaccaacgaggccuuccggaaggugcaggacgccgugaacaacaacgcgcaggcccuguccaagcucgccagcgagcuguccaacacguucggcgccaucagcgccuccaucggcgacaucauccagcgccuggacgugcucgagcaggacgcgcagaucgaccggcugaucaacgggcgccugaccacccucaacgccuucgucgcccagcagcuggugcggagcgaguccgccgcgcugagcgcccagcucgccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccugugcgacgccgccaaccccacgaacugcaucgccccggugaacggguacuucaucaagaccaacaacacccggaucgucgacgaguggagcuacaccggcagcuccuucuacgcccccgagcccaucacgagccucaacaccaaguacguggcgccccaggugaccuaccagaacaucuccaccaaccugccgccgccccugcucgggaacagcaccggcaucgacuuccaggacgagcuggacgacuucuucaagaacgucuccacgagcauccccaacuucggcucccugacccagaucaacaccacccuccuggaccugacguacgagaugcucagccugcagcaggucgugaaggcccugaacgaguccuacaucgaccucaaggagcuggggaacuacaccuacuacaacaaguggcccugguacaucuggcugggcuucaucgccgggcucguggcccuggcccugugcguguucuucauccucugcugcaccggcugcgggaccaacugcaugggcaagcugaagugcaaccgcugcugcgaccgcuacgaggaguacgaccuggagccccacaaggugcacguccacuga

SEQ ID NO: 374 - RNA, 4062 nt, Artificial Sequence
  derived and/or modified CDS sequence (opt1) from MERS-CoV__AMW90853__S
augauccacagcguguuccugcucauguuccugcugacccccaccgaguccuacgucgacgugggcagcgacuccgugaaguccgccugcaucgaggucgacauccagcagacguucuucgacaagaccuggccgcgccccaucgacguguccaaggccgacgggaucaucuacccccagggccggaccuacagcaacaucaccaucacguaccaggggcuguuccccuaccagggcgaccacggggacauguacguguacuccgcgggcuacgccaccggcaccaccccgcagaagcuguucgucgccaacuacagccaggacgugaagcaguucgccaacggguucgugguccgcaucggcgccgcggccaacuccacggggaccgugaucaucagccccuccaccagcgccaccauccggaagaucuaccccgccuucaugcugggcuccagcguggggaacuucuccgacggcaagaugggccgcuucuucaaccacacgcucguccugcugcccgacgggugcggcacccuccugcgggcguucuacugcauccuggagccgcgcagcgggaaccacugccccgccggcaacuccuacaccagcuucgccaccuaccacacgcccgccaccgacugcuccgacggcaacuacaaccggaacgccagccucaacagcuucaaggaguacuucaaccugcgcaacugcaccuucauguacaccuacaacaucacggaggacgagauccuggagugguucgggaucacccagaccgcgcagggcgugcaccucuucuccagccgguacguggaccuguacgggggcaacauguuccaguucgccacccugcccgucuacgacacgaucaaguacuacuccaucaucccgcacagcauccgcuccauccagagcgaccggaaggccugggccgccuucuacguguacaagcuccagccccugaccuuccugcucgacuucuccguggacggguacauccgccgggcgaucgacugcggcuucaacgaccugagccagcugcacugcuccuacgagagcuucgacgucgaguccggcguguacagcguguccagcuucgaggccaagcccuccgggagcgucguggagcaggccgagggcguggagugcgacuucagcccccuccugagcgggaccccgccccaggucuacaacuucaagcgccugguguucaccaacugcaacuacaacuucacgaagcuccugucccuguucagcgucaacgacuucacgugcagccagaucucccccgccgccaucgcgagcaacugcuacuccagccucauccuggacuacuucuccuacccccugagcaugaaguccgaccucagcguguccagcgccggcccgaucucccaguucaacuacaagcagagcuucuccaacccgaccugccugauccuggccaccgugccccacaaccucaccaccaucaccaagccccugaaguacagcuacaucaacaagugcucccggcugcucagcgacgaccgcaccgaggucccccagcuggugaacgccaaccaguacucccccugcgugagcaucguccccagcacggugugggaggacggggacuacuaccggaagcagcugagcccccucgagggcggcggguggcugguggccuccggcuccaccgucgcgaugaccgagcagcugcagaugggguucggcaucaccgugcaguacgggaccgacacgaacagcgugugcccgaagcucgaguucgccaacgacaccaagaucgccucccagcugggcaacugcgucgaguacagccuguacggcguguccgggcgcggcguguuccagaacugcaccgccgucggggugcggcagcagcgcuucguguacgacgcguaccagaaccucgucggcuacuacagcgacgacggcaacuacuacugccugcgggccugcguguccgugcccgucagcgugaucuacgacaaggagaccaagacgcacgccacccuguucggguccguggccugcgagcacaucagcuccaccaugagccaguacucccgcagcacccgcuccaugcugaagcggcgcgacagcacguacggcccccuccagaccccggucgggugcgugcugggccuggugaacuccagccucuucgucgaggacugcaagcugccccuggggcagagccucugcgcccugcccgacacccccuccacccugacgccgcggagcgugcgcuccgugcccggcgagaugcggcucgcgagcaucgccuucaaccaccccauccaggucgaccagcugaacuccagcuacuucaagcuguccauccccaccaacuucagcuucggcgugacccaggaguacauccagaccacgauccagaaggugaccgucgacugcaagcaguacgugugcaacggguuccagaagugcgagcagcuccugcgcgaguacggccaguucugcuccaagaucaaccaggcccugcacggggccaaccuccggcaggacgacagcgugcgcaaccuguucgccuccgucaagagcucccagagcuccccgaucauccccggcuucgggggcgacuucaaccugacccuccuggagcccgugagcaucuccaccggcagccgguccgcgcgcagcgccaucgaggaccuccucuucgacaaggugacgaucgccgaccccggguacaugcagggcuacgacgacugcaugcagcaggggccggccagcgcccgggaccugaucugcgcgcaguacgucgccggcuacaaggugcugccgccccucauggacgugaacauggaggccgccuacaccuccagccugcugggguccaucgcgggcgucggcuggaccgccgggcucagcuccuucgccgccauccccuucgcccagagcaucuucuaccgccugaacggcguggggaucacccagcagguccuguccgagaaccagaagcucaucgcgaacaaguucaaccaggcccugggcgccaugcagacgggguucaccaccaccaacgaggccuuccggaaggugcaggacgccgugaacaacaacgcgcaggcccugagcaagcucgccuccgagcugagcaacacguucggcgccaucuccgccagcaucggcgacaucauccagcgccuggacgugcucgagcaggacgcgcagaucgaccggcugaucaacgggcgccugaccacccucaacgccuucgucgcccagcagcuggugcgguccgagagcgccgcgcuguccgcccagcucgccaaggacaaggugaacgagugcgucaaggcccagagcaagcgcuccggcuucugcgggcagggcacccacaucgugagcuucgucgugaacgcccccaacggccuguacuucaugcacgugggguacuaccccuccaaccacaucgaggucgugagcgcguacggccugugcgacgccgccaaccccacgaacugcaucgcccccgugaacggguacuucaucaagaccaacaacacccggaucgucgacgaguggagcuacaccggcuccagcuucuacgccccggagcccaucacgucccucaacaccaaguacguggcgccccaggugaccuaccagaacaucagcaccaaccugcccccgccccugcucgggaacuccaccggcaucgacuuccaggacgagcuggacgaguucuucaagaacgucagcacguccauccccaacuucggcagccugacccagaucaacaccacccuccuggaccugacguacgagaugcucucccugcagcaggucgugaaggcccugaacgagagcuacaucgaccucaaggagcuggggaacuacaccuacuacaacaaguggccgugguacaucuggcugggcuucaucgccgggcucguggcccuggcccugugcguguucuucauccucugcugcaccggcugcgggaccaacugcaugggcaagcugaagugcaaccgcugcugcgaccgcuacgaggaguacgaccuggagccccacaaggugcacguccacuga

SEQ ID NO: 375 - RNA, 4062 nt, Artificial Sequence
  derived and/or modified CDS sequence (opt1) from MERS-CoV__ANC28656__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgggcgcaccgaggucccccagcuggugaacgccaaccaguacagccccugcguguccaucguccccagcacggugugggaggacggcgacuacuaccggaagcagcucagcccgcuggagggcgggggcuggcugguggccuccgggagcaccgucgcgaugaccgagcagcuccagaugggcuucgggaucaccgugcaguacggcaccgacacgaacuccgugugccccaagcuggaguucgccaacgacaccaagaucgccagccagcugggcaacugcgucgaguacucccucuacggggugagcggccgcgggguguuccagaacugcaccgccgucggcgugcggcagcagcgcuucguguacgacgcguaccagaaccuggucggcuacuacuccgacgacgggaacuacuacugccugcgggccugcgugagcgugcccgucuccgugaucuacgacaaggagaccaagacgcacgccacccuguucggcagcguggccugcgagcacaucuccagcaccaugucccaguacagccgcuccacccgcagcaugcucaagcggcgcgacuccacguacgggccgcugcagacccccgucggcugcgugcuggggcucgugaacagcucccuguucgucgaggacugcaagcugccccucggccagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggggugacccaggaguacauccagaccacgauccagaaggugaccgucgacugcaagcaguacgugugcaacggcuuccagaagugcgagcagcugcugcgcgaguacgggcaguucugcagcaagaucaaccaggcccuccacggcgccaaccugcggcaggacgacuccgugcgcaaccuguucgccagcgucaaguccagccaguccagccccaucauccccggguucggcggcgacuucaaccucacccugcuggagcccguguccaucagcaccgggucccggagcgcgcgcuccgccaucgaggaccuccuguucgacaaggugacgaucgccgacccgggcuacaugcagggguacgacgacugcaugcagcagggccccgccagcgcccgggaccugaucugcgcgcaguacgucgccggguacaaggugcucccgccccugauggacgugaacauggaggccgccuacaccagcucccugcucggcagcaucgcgggcgucggguggaccgccggccuguccagcuucgccgccauccccuucgcccaguccaucuucuaccgccugaacggggugggcaucacccagcagguccucagcgagaaccagaagcugaucgcgaacaaguucaaccaggcccugggggccaugcagacgggcuucaccaccaccaacgaggccuuccggaaggugcaggacgccgugaacaacaacgcgcaggcccucuccaagcuggccagcgagcuguccaacacguucggcgccaucagcgccuccaucggggacaucauccagcgccucgacgugcuggagcaggacgcgcagaucgaccggcugaucaacggccgccucaccacccugaacgccuucgucgcccagcagcuggugcggagcgaguccgccgcgcucagcgcccagcuggccaaggacaaggugaacgagugcgucaaggcccaguccaagcgcagcggguucugcggccagggcacccacaucguguccuucgucgugaacgcccccaacgggcuguacuucaugcacgugggcuacuaccccagcaaccacaucgaggucguguccgcguacgggcucugcgacgccgccaaccccacgaacugcaucgccccggugaacggcuacuucaucaagaccaacaacacccggaucgucgacgaguggagcuacaccgggagcuccuucuacgcccccgagcccaucacgagccugaacaccaaguacguggcgccccaggugaccuaccagaacaucuccaccaaccugccgccgccccuccugggcaacagcaccggcaucgacuuccaggacgagcuggacgaguucuucaagaacgucuccacgagcauccccaacuucgggucccucacccagaucaacaccacccugcuggaccucacguacgagaugcugagccugcagcaggucgugaaggcccucaacgaguccuacaucgaccugaaggagcugggcaacuacaccuacuacaacaaguggcccugguacaucuggcucggguucaucgccggccugguggcccuggcccucugcguguucuucauccugugcugcaccgggugcggcaccaacugcaugggcaagcugaagugcaaccgcugcugcgaccgcuacgaggaguacgaccucgagccccacaaggugcacguccacuga

SEQ ID NO: 376 - RNA, 4062 nt, Artificial Sequence
  derived and/or modified CDS sequence (opt1) from MERS-CoV__ANC28678__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccaucugcagcauccaguccgaccgcaaggccugggccgccuucuacguguacaagcuccagccccugaccuuccugcucgacuucagcguggacggguacauccggcgcgcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcggcugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccgccuccuguccgacgggcggaccgaggucccccagcuggugaacgccaaccaguacagccccugcguguccaucguccccagcacggugugggaggacggcgacuacuaccgcaagcagcucagcccgcuggagggcgggggcuggcugguggccuccgggagcaccgucgcgaugaccgagcagcuccagaugggcuucgggaucaccgugcaguacggcaccgacacgaacuccgugugccccaagcuggaguucgccaacgacaccaagaucgccagccagcugggcaacugcgucgaguacucccucuacggggugagcggccgcgggguguuccagaacugcaccgccgucggcgugcggcagcagcgguucguguacgacgcguaccagaaccuggucggcuacuacuccgacgacgggaacuacuacugccugcgcgccugcgugagcgugcccgucuccgugaucuacgacaaggagaccaagacgcacgccacccuguucggcagcguggccugcgagcacaucuccagcaccaugucccaguacagccgguccacccgcagcaugcucaagcgccgggacuccacguacgggccgcugcagacccccgucggcugcgugcuggggcucgugaacagcucccuguucgucgaggacugcaagcugccccucggccagagccugugcgcccugcccgacaccccgagcacccucacgccccgcuccgugcggagcgugcccggcgagaugcgccuggcguccaucgccuucaaccaccccauccaggucgaccagcugaacagcuccuacuucaagcucagcaucccgaccaacuucuccuucggggugacccaggaguacauccagaccacgauccagaaggugaccgucgacugcaagcaguacgugugcaacggcuuccagaagugcgagcagcugcugcgggaguacgggcaguucugcagcaagaucaaccaggcccuccacggcgccaaccugcgccaggacgacuccgugcggaaccuguucgccagcgucaaguccagccaguccagccccaucauccccggguucggcggcgacuucaaccucacccugcuggagcccguguccaucagcaccgggucccgcagcgcgcgguccgccaucgaggaccuccuguucgacaaggugacgaucgccgacccgggcuacaugcagggguacgacgacugcaugcagcagggccccgccagcgcccgcgaccugaucugcgcgcaguacgucgccggguacaaggugcucccgccccugauggacgugaacauggaggccgccuacaccagcucccugcucggcagcaucgcgggcgucggguggaccgccggccuguccagcuucgccgccauccccuucgcccaguccaucuucuaccggcugaacggggugggcaucacccagcagguccucagcgagaaccagaagcugaucgcgaacaaguucaaccaggcccugggggccaugcagacgggcuucaccaccaccaacgaggccuuccgcaaggugcaggacgccgugaacaacaacgcgcaggcccucuccaagcuggccagcgagcuguccaacacguucggcgccaucagcgccuccaucggggacaucauccagcggcucgacgugcuggagcaggacgcgcagaucgaccgccugaucaacggccggcucaccacccugaacgccuucgucgcccagcagcuggugcgcagcgaguccgccgcgcucagcgcccagcuggccaaggacaaggugaacgagugcgucaaggcccaguccaagcggagcggguucugcggccagggcacccacaucguguccuucgucgugaacgcccccaacgggcuguacuucaugcacgugggcuacuaccccagcaaccacaucgaggucguguccgcguacgggcucugcgacgccgccaaccccacgaacugcaucgccccggugaacggcuacuucaucaagaccaacaacacccgcaucgucgacgaguggagcuacaccgggagcuccuucuacgcccccgagcccaucacgagccugaacaccaaguacguggcgccccaggugaccuaccagaacaucuccaccaaccugccgccgccccuccugggcaacagcaccggcaucgacuuccaggacgagcuggacgaguucuucaagaacgucuccacgagcauccccaacuucgggucccucacccagaucaacaccacccugcuggaccucacguacgagaugcugagccugcagcaggucgugaaggcccucaacgaguccuacaucgaccugaaggagcugggcaacuacaccuacuacaacaaguggcccugguacaucuggcucggguucaucgccggccugguggcccuggcccucugcguguucuucauccugugcugcaccgggugcggcaccaacugcaugggcaagcugaagugcaaccggugcugcgaccgcuacgaggaguacgaccucgagccccacaaggugcacguccacuga

SEQ ID NO: 377 - RNA, 4059 nt, Artificial Sequence
  derived and/or modified CDS sequence (opt1) from MERS-CoV__AHL18090__S
augauccacagcguguuccugcucauguuccugcugacccccaccgaguccuacgucgacgugggccucgacagcgccaaguccgccugcaucgagguggacauccagcagacguucuucgacaagaccuggccgcgccccaucgacgucagcaaggcggacgggaucaucuacccccagggccggaccuacuccaacaucaccaucacguaccaggggcuguuccccuaccagggcgaccacggggacauguacguguacagcgccggccacgccaccggcaccaccccgcagaagcuguucguggccaacuacucccaggacgucaagcaguucgccaacggguucguggugcgcaucggcgcggccgccaacagcacggggaccgucaucaucucccccagcaccuccgccaccauccggaagaucuaccccgcguucaugcucggcagcuccguggggaacuucagcgacggcaagaugggccgcuucuucaaccacacgcuggugcugcuccccgacgggugcggcacccugcugcgggccuucuacugcauccucgagccgcgcuccgggaacuacugccccgccggcaacagcuacaccuccuucgccaccuaccacacgcccgccaccgacugcagcgacggcaacuacaaccggaacgcgucccugaacagcuucaaggaguacuucaaccugcgcaacugcaccuucauguacaccuacaacaucacggaggacgagauccucgagugguucgggaucacccagaccgcccagggcguccaccuguucagcucccgguacguggaccuguacgggggcaacauguuccaguucgccacccuccccguguacgacacgaucaaguacuacagcaucaucccgcacuccauccgcagcauccaguccgaccggaaggccugggccgcguucuacgucuacaagcugcagccccugaccuuccuccuggacuucagcguggacggguacauccgccgggccaucgacugcggcuucaacgaccugucccagcuccacugcagcuacgaguccuucgacguggagagcggcgucuacuccgugagcuccuucgaggccaagcccagcggguccguggucgagcaggccgagggcguggagugcgacuucagcccccugcuguccgggaccccgccccagguguacaacuucaagcgccucgucuucaccaacugcaacuacaaccugacgaagcugcucagccuguucuccgugaacgacuucacgugcagccagaucagccccgccgcgaucuccagcaacugcuacuccagccugauccucgacuacuucuccuacccccugagcaugaaguccgaccugagcgucuccagcgccggcccgaucucccaguucaacuacaagcagagcuucuccaacccgaccugccucauccuggccaccgugccccacaaccugaccaccaucaccaagccccucaaguacagcuacaucaacaagugcucccggcugcugagcgacgaccgcaccgaggugccccagcucgucaacgccaaccaguacucccccugcgugagcaucgugcccagcacggucugggaggacggggacuacuaccggaagcagcugagcccccuggagggcggcggguggcucguggccagcggcuccaccguggcgaugaccgagcagcugcagaugggguucggcaucaccguccaguacgggaccgacacgaacagcgugugcccgaagcuggaguucgccaacgacaccaagaucgccucccagcucggcaacugcguggaguacagccuguacggcgucuccgggcgcggcguguuccagaacugcaccgccguggggguccggcagcagcgcuucguguacgacgcguaccagaaccuggugggcuacuacagcgacgacggcaacuacuacugccugcgggccugcgucuccgugcccgugagcgucaucuacgacaagaagaccaagacgcacgccacccucuucggguccguggccugcgagcacaucagcuccaccaugagccaguacucccgcagcacccgcuccacgcugaagcggcgcgacagcaccuacggcccccugcagaccccgguggggugcguccucggccuggugaacuccagccuguucguggaggacugcaagcucccccuggggcagagccugugcgcccuccccgacacccccuccacgcugaccccgcggagcguccgcuccgugcccggccagaugcggcuggcgagcaucgccuucaaccaccccauccagguggaccagcucaacuccagcuacuucaagcuguccauccccaccaacuucagcuucggcgucacccaggaguacauccagacgaccauccagaaggugaccguggacugcaagcaguacgucugcaacggguuccagaagugcgagcagcugcuccgcgaguacggccaguucugcuccaagaucaaccaggcccugcacggggccaaccugcggcaggacgacagcgugcgcaaccucuucgccuccgugaaguccucccagagcuccccgaucauccccggcuucgggggcgacuucaaccugacccugcucgagcccgucagcaucuccacgggcagccgguccagccgcaucgcgaucgaggaccugcuguucgacaaggugaccaucgccgaccccggguacaugcagggcuacgacgacugcaugcagcaggggccgagcuccgcccgggaccucaucugcgcccaguacguggccggcuacaagguccugccgccccugauggacgugaacauggaggcggccuacaccagcucccuccuggggagcaucgccggcgugggcuggaccgccgggcuguccagcuucgcggccauccccuucgcccaguccaucuucuaccgccucaacggcgucgggaucacgcagcagguccugagcgagaaccagaagcugaucgccaacaaguucaaccaggcccucggcgcgaugcagaccggguucaccaccacgaacgaggccuuccagaaggugcaggacgccgugaacaacaacgcccaggcccuguccaagcuggcgagcgagcucuccaacaccuucggcgccaucagcgccuccaucggcgacaucauccagcggcuggacgugcuggagcaggacgcccagaucgaccgccucaucaacgggcggcugaccacccugaacgccuucguggcgcagcagcucguccgcagcgaguccgccgcccugagcgcccagcuggcgaaggacaaggugaacgagugcgugaaggcccaguccaagcggagcggcuucugcgggcagggcacgcacaucgucuccuucguggucaacgcccccaacggccucuacuucaugcacgugggguacuaccccagcaaccacaucgagguggucagcgccuacggccugugcgacuccgccaaccccaccaacugcaucgcgcccgugaacggguacuucaucaagaccaacaacacccgcaucguggacgaguggagcuacacgggcuccagcuucuacgccccggagcccaucaccucccugaacaccaaguacgucgcgccccaggugaccuaccagaacaucagcaccaaccugcccccgccccuccuggggaacuccacgggcaucgacuuccaggacgagcucgacgaguucuucaagaacgugagcaccuccauccccaacuucggcagccugacccagaucaacaccacgcugcucgaccugaccuacgagaugcugucccuccagcaggucgugaaggcccugaacgagagcuacaucgaccugaaggagcucgggaacuacaccuacuacaaguggccgugguacaucuggcugggcuucaucgccgggcugguggcccucgcccugugcgucuucuucauccugugcugcaccggcugcgggacgaacugcaugggcaagcucaagcggaaccgcugcugcgaccgcuacgaggaguacgaccuggagccccacaaggugcacgugcacuga

SEQ ID NO: 378 - RNA, 4062 nt, Artificial Sequence
  derived and/or modified CDS sequence (opt1) from MERS-CoV__AHX00731__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugggggugagcagcgccgggcccaucucccaguucaacuacaagcagagcuucuccaacccgaccugccugauccucgccaccgugccccacaaccugaccaccaucaccaagccccugaaguacagcuacaucaacaagugcucccggcuccugagcgacgaccgcaccgaggucccccagcuggugaacgccaaccaguacucccccugcgugagcaucguccccuccacggugugggaggacggcgacuacuaccggaagcagcucagcccgcuggagggcgggggcuggcugguggccagcggguccaccgucgcgaugaccgagcagcuccagaugggcuucgggaucaccgugcaguacggcaccgacacgaacagcgugugccccaagcuggaguucgccaacgacaccaagaucgccucccagcugggcaacugcgucgaguacagccucuacgggguguccggccgcgggguguuccagaacugcaccgccgucggcgugcggcagcagcgcuucguguacgacgcguaccagaaccuggucggcuacuacagcgacgacgggaacuacuacugccugcgggccugcguguccgugcccgucagcgugaucuacgacaaggagaccaagacgcacgccacccuguucggcuccguggccugcgagcacaucagcuccaccaugagccaguacucccgcagcacccgcuccaugcucaagcggcgcgacagcacguacgggccgcugcagacccccgucggcugcgugcuggggcucgugaacuccagccuguucgucgaggacugcaagcugccccucggccagucccugugcgcccugcccgacaccccgagcacccucacgccccggagcgugcgcuccgugcccggcgagaugcggcuggcgagcaucgccuucaaccaccccauccaggucgaccaguucaacuccagcuacuucaagcuguccaucccgaccaacuucagcuucggggugacccaggaguacauccagaccacgauccagaaggugaccgucgacugcaagcaguacaucugcaacggcuuccagaagugcgagcagcuccugcgcgaguacgggcaguucugcuccaagaucaaccaggcccugcacggcgccaaccuccggcaggacgacagcgugcgcaaccuguucgccuccgucaagagcucccagagcucccccaucauccccggguucggcggcgacuucaaccugacccuccuggagcccgugagcaucuccaccgggagccgguccgcgcgcagcgccaucgaggaccuccuguucgacaaggugacgaucgccgacccgggcuacaugcagggguacgacgacugcaugcagcagggccccgccuccgcccgggaccugaucugcgcgcaguacguggccggguacaagguccugccgccccucauggacgugaacauggaggccgccuacaccagcagccugcugggcuccaucgcgggcgugggguggaccgccggccucagcuccuucgccgccauccccuucgcccagagcaucuucuaccgccugaacggggucggcaucacccagcagguccuguccgagaaccagaagcucaucgcgaacaaguucaaccaggcccugggggccaugcagacgggcuucaccaccaccaacgaggccuuccggaaggugcaggacgccgugaacaacaacgcgcaggcccugagcaagcucgccuccgagcugagcaacacguucggcgccaucuccgccagcaucggggacaucauccagcgccuggacgugcucgagcaggacgcgcagaucgaccggcugaucaacggccgccugaccacccucaacgccuucguggcccagcagcugguccgguccgagagcgccgcgcuguccgcccagcucgccaaggacaaggugaacgagugcgugaaggcccagagcaagcgcuccggguucugcggccagggcacccacaucgucagcuucguggucaacgcccccaacgggcuguacuucaugcacgugggcuacuaccccuccaaccacaucgagguggucagcgcguacgggcugugcgacgccgccaaccccacgaacugcaucgccccggugaacggcuacuucaucaagaccaacaacacccggaucguggacgagugguccuacaccgggagcagcuucuacucccccgagcccaucacgagccucaacaccaaguacgucgcgccccaggugaccuaccagaacaucuccaccaaccugccgccgccccugcucggcaacagcaccggcaucgacuuccaggacgagcuggacgaguucuucaagaacguguccacgagcauccccaacuucgggucccugacccagaucaacaccacccuccuggaccugacguacgagaugcucagccugcagcaggucgugaaggcccugaacgaguccuacaucgaccucaaggagcugggcaacuacaccuacuacaacaaguggcccugguacaucuggcugggguucaucgccggccucguggcccuggcccugugcgucuucuucauccucugcugcaccgggugcggcaccaacugcaugggcaagcugaagugcaaccgcugcugcgaccgcuacgaggaguacgaccuggagccccacaaggugcacgugcacuga

SEQ ID NO: 379 - RNA, 4062 nt, Artificial Sequence
  derived and/or modified CDS sequence (opt1) from MERS-CoV__AHX71946__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagccacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccagcgccucgacgugcuggagcaggacgcgcagaucgaccggcugaucaacgggcgccucaccacccugaacgccuucgucgcccagcagcuggugcggagcgaguccgccgcgcucagcgcccagcuggccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccggaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 380 - RNA, 4062 nt, Artificial Sequence
  derived and/or modified CDS sequence (opt1) from MERS-CoV__AHY22545__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaaccgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccagcgccucgacgugcuggagcaggacgcgcagaucgaccggcugaucaacgggcgccucaccacccugaacgccuucgucgcccagcagcuggugcggagcgaguccgccgcgcucagcgcccagcuggccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccggaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 381 - RNA, 4062 nt, Artificial Sequence
  derived and/or modified CDS sequence (opt1) from MERS-CoV__AHY22555__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaacuacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccagcuucuacguguacaagcuccagccccugaccuuccugcucgacuucuccguggacggguacauccgccgggccaucgacugcggcuucaacgaccugagccagcugcacugcuccuacgagagcuucgacgucgaguccggcguguacagcguguccagcuucgaggcgaagcccuccgggagcgucguggagcaggccgagggcguggagugcgacuucuccccgcuccugagcgggaccccgccccaggucuacaacuucaagcgccugguguucaccaacugcaacuacaaccucacgaagcugcugucccucuucagcgucaacgacuucacgugcagccagaucucccccgccgccaucgccagcaacugcuacuccagccugauccuggacuacuucuccuacccccucagcaugaaguccgaccugagcguguccagcgcggggcccaucucccaguucaacuacaagcagagcuucuccaacccgaccugccugauccucgccaccgugccccacaaccugaccaccaucaccaagccccugaaguacagcuacaucaacaagugcucccggcuccugagcgacgaccgcaccgaggucccccagcuggugaacuccaaccaguacagccccugcgugagcaucguccccuccacggugugggaggacggggacuacuaccggaagcagcucagcccgcuggagggcggcggguggcugguggccuccggcagcaccgucgccaugaccgagcagcuccagaugggguucggcaucaccgugcaguacgggaccgacacgaacuccgugugccccaagcuggaguucgccaacgacaccaagaucgcgagccagcugggcaacugcgucgaguacucccucuacggcgugagcgggcgcggcguguuccagaacugcaccgccgucggggugcggcagcagcgcuucguguacgacgccuaccagaaccuggucggcuacuacuccgacgacggcaacuacuacugccugcgggccugcgugagcgugcccgucuccgugaucuacgacaaggagaccaagacgcacgcgacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcagccuguucgucgaggacugcaagcugccccucgggcagucccugugcgcccugcccgacaccccgagcacccucacgccccgguccgugcgcagcgugcccggcgagaugcggcuggccuccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcgcuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcccgcagcgccaucgaggaccuccuguucgacaaggugacgaucgcggacccgggguacaugcagggcuacgacgacugcaugcagcaggggcccgccuccgcccgggaccugaucugcgcccaguacgucgccggcuacaaggugcucccgccccugauggacgugaacauggaggcggccuacaccagcucccugcucgggagcaucgccggcgucggcuggaccgccgggcuguccagcuucgcggccauccccuucgcccaguccaucuucuaccgccugaacggcguggggaucacccagcagguccucagcgagaaccagaagcugaucgccaacaaguucaaccaggcccugggcgcgaugcagacgggguucaccaccaccaacgaggccuuccacaaggugcaggacgccgugaacaacaacgcccaggcccucuccaagcuggcgagcgagcuguccaacacguucggcgccaucagcgccuccaucggcgacaucauccagcggcucgacgugcuggagcaggacgcccagaucgaccgccugaucaacgggcggcucaccacccugaacgccuucgucgcgcagcagcuggugcgcagcgaguccgccgcccucagcgcccagcuggcgaaggacaaggugaacgagugcgucaaggcccaguccaagcggagcggcuucugcgggcagggcacccacaucguguccuucgucgugaacgcccccaacggccuguacuucaugcacgugggguacuaccccagcaaccacaucgaggucgugagcgccuacggccucugcgacgccgcgaaccccacgaacugcaucgccccggugaacggguacuucaucaagaccaacaacacccgcaucgucgacgagugguccuacaccggcagcuccuucuacgcccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccggugcugcgaccgcuacgaggaguacgaccucgagccccacaaggugcacguccacuga

SEQ ID NO: 382 - RNA, 4062 nt, Artificial Sequence
  derived and/or modified CDS sequence (opt1) from MERS-CoV__AHY22565__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaucauccggaagaucuaccccgccuucaugcugggcagcuccguggggaacuucagcgacggcaagaugggccgcuucuucaaccacacccucguccugcugccggacgggugcggcacgcuccugcgggcguucuacugcauccuggagccccgcuccgggaaccacugccccgccggcaacagcuacaccuccuucgccaccuaccacacccccgccacggacugcagcgacggcaacuacaaccggaacgccucccucaacagcuucaaggaguacuucaaccugcgcaacugcaccuucauguacaccuacaacaucaccgaggacgagauccuggagugguucgggaucacgcagaccgcgcagggcgugcaccucuucagcucccgguacguggaccuguacgggggcaacauguuccaguucgccacccugccggucuacgacaccaucaaguacuacagcaucaucccccacuccauccgcagcauccaguccgaccggaaggccugggccagcuucuacguguacaagcuccagccccugacguuccugcucgacuucuccguggacggguacauccgccgggccaucgacugcggcuucaacgaccugagccagcugcacugcuccuacgagagcuucgacgucgaguccggcguguacagcguguccagcuucgaggcgaagcccuccgggagcgucguggagcaggccgagggcguggagugcgacuucuccccgcuccugagcgggaccccgccccaggucuacaacuucaagcgccugguguucaccaacugcaacuacaaccucaccaagcugcugucccucuucagcgucaacgacuucacgugcagccagaucucccccgccgccaucgccagcaacugcuacuccagccugauccuggacuacuucuccuacccccucagcaugaaguccgaccugagcguguccagcgcggggcccaucucccaguucaacuacaagcagagcuucuccaacccgaccugccugauccucgccaccgugccccacaaccugaccacgaucaccaagccccugaaguacagcuacaucaacaagugcucccggcuccugagcgacgaccgcaccgaggucccccagcuggugaacgccaaccaguacucccccugcgugagcaucguccccagcaccgugugggaggacggggacuacuaccggaagcagcucuccccgcuggagggcggcggguggcugguggccagcggcuccacggucgccaugaccgagcagcuccagaugggguucggcaucaccgugcaguacgggaccgacaccaacagcgugugccccaagcuggaguucgcgaacgacacgaagaucgccucccagcugggcaacugcgucgaguacagccucuacggcguguccgggcgcggcguguuccagaacugcaccgccgucggggugcggcagcagcgcuucguguacgacgccuaccagaaccuggucggcuacuacagcgacgacggcaacuacuacugccugcgggcgugcguguccgugcccgucagcgugaucuacgacaaggagaccaagacccacgccacgcuguucggguccguggccugcgagcacaucagcuccaccaugagccaguacucccgcagcacccgcuccaugcucaagcggcgcgacagcaccuacggcccgcugcagacgcccgucgggugcgugcugggccucgugaacuccagccuguucgucgaggacugcaagcugccccucgggcagagccugugcgcccugcccgacaccccguccacccucacgccccggagcgugcgcuccgugcccggcgagaugcggcuggccagcaucgcguucaaccaccccauccaggucgaccagcugaacuccagcuacuucaagcucuccaucccgaccaacuucagcuucggcgugacccaggaguacauccagaccaccauccagaaggugacggucgacugcaagcaguacgugugcaacggguuccagaagugcgagcagcugcugcgcgaguacggccaguucugcuccaagaucaaccaggcccuccacggggccaaccugcggcaggacgacagcgugcgcaaccuguucgccuccgucaagagcucccagagcucccccaucauccccggcuucgggggcgacuucaaccucacccugcuggagcccgugagcaucuccaccggcagccgguccgcccgcagcgcgaucgaggaccuccuguucgacaaggugaccaucgccgacccgggguacaugcagggcuacgacgacugcaugcagcaggggcccgccagcgcccgggaccugaucugcgcccaguacgucgcgggcuacaaggugcucccgccccugauggacgugaacauggaggccgccuacacguccagccugcucggguccaucgccggcgucggcuggaccgcggggcugagcuccuucgccgccauccccuucgcccagagcaucuucuaccgccugaacggcguggggaucacccagcagguccucuccgagaaccagaagcugaucgccaacaaguucaaccaggcgcugggcgccaugcagaccggguucacgaccaccaacgaggccuuccggaaggugcaggacgccgugaacaacaacgcccaggcgcucagcaagcuggccuccgagcugagcaacaccuucggcgccaucuccgccagcaucggcgacaucauccagcgccucgacgugcuggagcaggacgcccagaucgaccggcugaucaacgggcgccucacgacccugaacgcguucgucgcccagcagcuggugcgguccgagagcgccgcccucuccgcgcagcuggccaaggacaaggugaacgagugcgucaaggcccagagcaagcgcuccggcuucugcgggcagggcacccacaucgugagcuucgucgugaacgcccccaacggccuguacuucaugcacgugggguacuaccccuccaaccacaucgaggucgugagcgccuacggccucugcgacgcgagcaaccccaccaacugcaucgccccggugaacggguacuucaucaagacgaacaacacccggaucgucgacgagugguccuacaccggcagcuccuucuacagccccgagcccaucaccucccugaacacgaaguacguggcgccccaggugaccuaccagaacaucagcaccaaccugccgccgccccuccuggggaacuccaccggcaucgacuuccaggacgagcuggacgaguucuucaagaacgucagcaccuccauccccaacuucggcagccucacgcagaucaacaccacccugcuggaccucaccuacgagaugcugucccugcagcaggucgugaaggcccucaacgagagcuacaucgaccugaaggagcuggggaacuacacguacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 383 - RNA, 4062 nt, Artificial Sequence
  derived and/or modified CDS sequence (opt1) from MERS-CoV__AJG44069__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccgcaagcuguucgucgccaacuacucccaggacgugaagcaguucgccaacggguucgugguccggaucggcgccgcggccaacagcaccgggaccgugaucaucucccccagcaccuccgccaccauccgcaagaucuaccccgccuucaugcugggcagcuccguggggaacuucagcgacggcaagaugggccgguucuucaaccacacgcucguccugcugccggacgggugcggcacccuccugcgcgcguucuacugcauccuggagccccgguccgggaaccacugccccgccggcaacagcuacaccuccuucgccaccuaccacacgcccgccaccgacugcagcgacggcaacuacaaccgcaacgccucccucaacagcuucaaggaguacuucaaccugcggaacugcaccuucauguacaccuacaacaucacggaggacgagauccuggagugguucgggaucacccagaccgcgcagggcgugcaccucuucagcucccgcuacguggaccuguacgggggcaacauguuccaguucgccacccugccggucuacgacacgaucaaguacuacagcaucaucccccacuccauccggagcauccaguccgaccgcaaggccugggccgccuucuacguguacaagcuccagccccugaccuuccugcucgacuucagcguggacggguacauccggcgcgcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcggcugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccgcugaaguacuccuacaucaacaagugcagccgccuccuguccgacgaccggaccgaggucccccagcuggugaacgccaaccaguacagccccugcguguccaucguccccagcacggugugggaggacggggacuacuaccgcaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcggggcguguuccagaacugcaccgccgucggggugcgccagcagcgguucguguacgacgcguaccagaaccuggucggcuacuacuccgacgacggcaacuacuacugccugcgcgccugcgugagcgugcccgucuccgugaucuacgacaaggagaccaagacgcacgccacccuguucgggagcguggccugcgagcacaucuccagcaccaugucccaguacagccgcuccacccggagcaugcucaagcgccgggacuccacguacggcccgcugcagacccccgucgggugcgugcugggccucgugaacagcucccuguucgucgaggacugcaagcugccccucgggcagagccugugcgcccugcccgacaccccgagcccccucacgccccgcuccgugcggagcgugcccggcgagaugcgccuggcguccaucgccuucaaccacccgauccaggucgaccagcugaacagcuccuacuucaagcucagcauccccaccaacuucuccuucggcgugacccaggaguacauccagaccaccauccagaaggugacggucgacugcaagcaguacaucugcaacggguuccagaagugcgagcagcugcugcgggaguacggccaguucugcagcaagaucaaccaggcccuccacggggccaaccugcgccaggacgacuccgugcggaaccuguucgccagcgugaaguccagccaguccagccccaucauccccggcuucgggggcgacuucaaccucacccugcuggagccggucuccaucagcaccggcucccgcagcgcgcgguccgccaucgaggaccuccuguucgacaaggugaccaucgccgaccccggguacaugcagggcuacgacgacugcaugcagcaggggcccgccagcgcccgcgaccugaucugcgcgcaguacguggccggcuacaagguccugcccccgcucauggacgugaacauggaggccgccuacacgagcucccugcucgggagcaucgcgggcgugggcuggaccgccgggcuguccagcuucgccgccauccccuucgcccaguccaucuucuaccggcugaacggcgucgggaucacccagcagguccucagcgagaaccagaagcugaucgcgaacaaguucaaccaggcccugggcgccaugcagaccggguucacgaccaccaacgaggccuuccgcaaggugcaggacgccgugaacaacaacgcgcaggcccucuccaagcuggccagcgagcuguccaacaccuucggcgccaucagcgccuccaucggcgacaucauccagcggcucgacgugcuggagcaggacgcgcagaucgaccgccugaucaacgggcggcucacgacccugaacgccuucguggcccagcagcugguccgcagcgaguccgccgcgcucagcgcccagcuggccaaggacaaggugaacgagugcgugaaggcccaguccaagcggagcggcuucugcgggcagggcacccacaucgucuccuucguggucaacgcccccaacggccuguacuucaugcacgugggguacuaccccagcaaccacaucgagguggucuccgcguacggccucugcgacgccgccaacccgaccaacugcaucgcccccgugaacggguacuucaucaagacgaacaacacccgcaucguggacgaguggagcuacaccggcagcuccuucuacagccccgagcccaucaccucccugaacacgaaguacgucgcgccccaggugaccuaccagaacaucagcaccaaccugcccccgccccuccuggggaacuccaccggcaucgacuuccaggacgagcuggacgaguucuucaagaacgugagcaccuccauccccaacuucggcagccucacgcagaucaacaccacccugcuggaccucaccuacgagaugcugucccugcagcaggucgugaaggcccucaacgagagcuacaucgaccugaaggagcuggggaacuacacguacuacaacaaguggcccugguacaucuggcucggcuucaucgccgggcugguggcccuggcccucugcgucuucuucauccugugcugcaccggcugcgggaccaacugcaugggcaagcugaagugcaaccgcugcugcgaccgguacgaggaguacgaccucgagccccacaaggugcacgugcacuga

SEQ ID NO: 384 - RNA, 4062 nt, Artificial Sequence
  derived and/or modified CDS sequence (opt1) from MERS-CoV__AJG44080__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcaucaaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccgcugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcccccucacgccccgguccgugcgcagcgugcccggcgagaugcggcuggcguccaucgccuucaaccacccgauccaggucgaccagcugaacagcuccuacuucaagcucagcauccccaccaacuucuccuucggcgugacccaggaguacauccagaccaccauccagaaggugacggucgacugcaagcaguacaucugcaacggguuccagaagugcgagcagcugcugcgcgaguacggccaguucugcagcaagaucaaccaggcccuccacggggccaaccugcggcaggacgacuccgugcgcaaccuguucgccagcgugaaguccagccaguccagccccaucauccccggcuucgggggcgacuucaaccucacccugcuggagccggucuccaucagcaccggcucccggagcgcgcgcuccgccaucgaggaccuccuguucgacaaggugaccaucgccgaccccggguacaugcagggcuacgacgacugcaugcagcaggggcccgccagcgcccgggaccugaucugcgcgcaguacguggccggcuacaagguccugcccccgcucauggacgugaacauggaggccgccuacacgagcucccugcucgggagcaucgcgggcgugggcuggaccgccgggcuguccagcuucgccgccauccccuucgcccaguccaucuucuaccgccugaacggcgucgggaucacccagcagguccucagcgagaaccagaagcugaucgcgaacaaguucaaccaggcccugggcgccaugcagaccggguucacgaccaccaacgaggccuuccggaaggugcaggacgccgugaacaacaacgcgcaggcccucuccaagcuggccagcgagcuguccaacaccuucggcgccaucagcgccuccaucggcgacaucauccagcgccucgacgugcuggagcaggacgcgcagaucgaccggcugaucaacgggcgccucacgacccugaacgccuucguggcccagcagcugguccggagcgaguccgccgcgcucagcgcccagcuggccaaggacaaggugaacgagugcgugaaggcccaguccaagcgcagcggcuucugcgggcagggcacccacaucgucuccuucguggucaacgcccccaacggccuguacuucaugcacgugggguacuaccccagcaaccacaucgagguggucuccgcguacggccucugcgacgccgccaacccgaccaacugcaucgcccccgugaacggguacuucaucaagacgaacaacacccggaucguggacgaguggagcuacaccggcagcuccuucuacagccccgagcccaucaccucccugaacacgaaguacgucgcgccccaggugaccuaccagaacaucagcaccaaccugcccccgccccuccuggggaacuccaccggcaucgacuuccaggacgagcuggacgaguucuucaagaacgugagcaccuccauccccaacuucggcagccucacgcagaucaacaccacccugcuggaccucaccuacgagaugcugucccugcagcaggucgugaaggcccucaacgagagcuacaucgaccugaaggagcuggggaacuacacguacuacaacaaguggcccugguacaucuggcucggcuucaucgccgggcugguggcccuggcccucugcgucuucuucauccugugcugcaccggcugcgggaccaacugcaugggcaagcugaagugcaaccgcugcugcgaccgcuacgaggaguacgaccucgagccccacaaggugcacgugcacuga

SEQ ID NO: 385 - RNA, 4062 nt, Artificial Sequence
  derived and/or modified CDS sequence (opt1) from MERS-CoV__AJG44102__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugucccacaaccugaccaccaucaccaagccccugaaguacagcuacaucaacaagugcucccggcuccugagcgacgaccgcaccgaggucccccagcuggugaacgccaaccaguacucccccugcgugagcaucguccccagcacggugugggaggacggggacuacuaccggaagcagcucagcccccuggagggcggcggguggcugguggccuccggcuccaccgucgcgaugaccgagcagcuccagaugggguucggcaucaccgugcaguacgggaccgacacgaacagcgugugcccgaagcuggaguucgccaacgacaccaagaucgccucccagcugggcaacugcgucgaguacagccucuacggcguguccgggcgcggcguguuccagaacugcaccgccgucggggugcggcagcagcgcuucguguacgacgcguaccagaaccuggucggcuacuacagcgacgacggcaacuacuacugccugcgggccugcguguccgugcccgucagcgugaucuacgacaaggagaccaagacgcacgccacccuguucggguccguggccugcgagcacaucagcuccaccaucagccaguacucccgcagcacccgcuccaugcucaagcggcgcgacagcacguacggcccccugcagaccccggucgggugcgugcugggccucgugaacuccagccuguucgucgaggacugcaagcugccccucgggcagagccugugcgcccugcccgacacccccuccacccucacgccgcggagcgugcgcuccgugcccggcgagaugcggcuggcgagcaucgccuucaaccaccccauccaggucgaccagcugaacuccagcuacuucaagcucuccauccccaccaacuucagcuucggcgugacccaggaguacauccagaccacgauccagaaggugaccgucgacugcaagcaguacgugugcaacggguuccagaagugcgagcagcugcugcgcgaguacggccaguucugcuccaagaucaaccaggcccuccacggggccaaccugcggcaggacgacagcgugcgcaaccuguucgccuccgucaagagcucccagagcuccccgaucauccccggcuucgggggcgacuucaaccucacccugcuggagcccgugagcaucuccaccggcagccgguccgcgcgcagcgccaucgaggaccuccuguucgacaaggugacgaucgccgaccccggguacaugcagggcuacgacgacugcaugcagcaggggccggccagcgcccgggaccugaucugcgcgcaguacgucgccggcuacaaggugcucccgccccugauggacgugaacauggaggccgccuacaccuccagccugcucggguccaucgcgggcgucggcuggaccgccgggcugagcuccuucgccgccauccccuucgcccagagcaucuucuaccgccugaacggcguggggaucacccagcagguccucuccgagaaccagaagcugaucgcgaacaaguucaaccaggcccugggcgccaugcagacgggguucaccaccaccaacgaggccuuccggaaggugcaggacgccgugaacaacaacgcgcaggcccucagcaagcuggccuccgagcugagcaacacguucggcgccaucuccgccagcaucggcgacaucauccagcgccucgacgugcuggagcaggacgcgcagaucgaccggcugaucaacgggcgccucaccacccugaacgccuucgucgcccagcagcuggugcgguccgagagcgccgcgcucuccgcccagcuggccaaggacaaggugaacgagugcgucaaggcccagagcaagcgcuccggcuucugcgggcagggcacccacaucgugagcuucgucgugaacgcccccaacggccuguacuucaugcacgugggguacuaccccuccaaccacaucgaggucgugagcgcguacggccucugcgacgccgccaaccccacgaacugcaucgcccccgugaacggguacuucaucaagaccaacaacacccggaucgucgacgaguggagcuacaccggcuccagcuucuacuccccggagcccaucacgagccugaacaccaaguacguggcgccccaggugaccuaccagaacaucuccaccaaccugcccccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggccgugguacaucuggcucggcuucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 386 - RNA, 4062 nt, Artificial Sequence
  derived and/or modified CDS sequence (opt1) from MERS-CoV__AJG44124__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccauguuccaguacucccgcagcacccgcuccaugcucaagcggcgcgacagcacguacggcccgcugcagacccccgucgggugcgugcugggccucgugaacuccagccuguucgucgaggacugcaagcugccccucgggcagucccugugcgcccugcccgacaccccgagcacccucacgccccggagcgugcgcuccgugcccggcgagaugcggcuggcgagcaucgccuucaaccaccccauccaggucgaccagcugaacuccagcuacuucaagcucuccaucccgaccaacuucagcuucggcgugacccaggaguacauccagaccacgauccagaaggugaccgucgacugcaagcaguacgugugcaacggguuccagaagugcgagcagcugcugcgcgaguacggccaguucugcuccaagaucaaccaggcccuccacggggccaaccugcggcaggacgacagcgugcgcaaccuguucgccuccgucaagagcucccagagcucccccaucauccccggcuucgggggcgacuucaaccucacccugcuggagcccgugagcaucuccaccggcagccgguccgcgcgcagcgccaucgaggaccuccuguucgacaaggugacgaucgccgacccgggguacaugcagggcuacgacgacugcaugcagcaggggcccgccuccgcccgggaccugaucugcgcgcaguacgucgccggcuacaaggugcucccgccccugauggacgugaacauggaggccgccuacaccagcagccugcucggguccaucgcgggcgucggcuggaccgccgggcugagcuccuucgccgccauccccuucgcccagagcaucuucuaccgccugaacggcguggggaucacccagcagguccucuccgagaaccagaagcugaucgcgaacaaguucaaccaggcccugggcgccaugcagacgggguucaccaccaccaacgaggccuuccggaaggugcaggacgccgugaacaacaacgcgcaggcccucagcaagcuggccuccgagcugagcaacacguucggcgccaucuccgccagcaucggcgacaucauccagcgccucgacgugcuggagcaggacgcgcagaucgaccggcugaucaacgggcgccucaccacccugaacgccuucgucgcccagcagcuggugcgguccgagagcgccgcgcucuccgcccagcuggccaaggacaaggugaacgagugcgucaaggcccagagcaagcgcuccggcuucugcgggcagggcacccacaucgugagcuucgucgugaacgcccccaacggccuguacuucaugcacgugggguacuaccccuccaaccacaucgaggucgugagcgcguacggccucugcgacgccgccaaccccacgaacugcaucgccccggugaacggguacuucaucaagaccaacaacacccggaucgucgacgagugguccuacaccggcagcagcuucuacucccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 387 - RNA, 4062 nt, Artificial Sequence
  derived and/or modified CDS sequence (opt1) from MERS-CoV__ALL26396__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccugagcgucgaggacugcaagcugccccucgggcagagccugugcgcccugcccgacaccccguccacccucacgccccggagcgugcgcuccgugcccggcgagaugcggcuggcgagcaucgccuucaaccaccccauccaggucgaccagcugaacuccagcuacuucaagcucuccaucccgaccaacuucagcuucggcgugacccaggaguacauccagaccacgauccagaaggugaccgucgacugcaagcaguacgugugcaacggguuccagaagugcgagcagcugcugcgcgaguacggccaguucugcuccaagaucaaccaggcccuccacggggccaaccugcggcaggacgacagcgugcgcaaccuguucgccuccgucaagagcucccagagcucccccaucauccccggcuucgggggcgacuucaaccucacccugcuggagcccgugagcaucuccaccggcagccgguccgcgcgcagcgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccuccagccugcucggguccaucgcgggcgucggcuggaccgccgggcugagcuccuucgccgccauccccuucgcccagagcaucuucuaccgccugaacggcguggggaucacccagcagguccucuccgagaaccagaagcugaucgcgaacaaguucaaccaggcccugggcgccaugcagacgggguucaccaccaccaacgaggccuuccggaaggugcaggacgccgugaacaacaacgcgcaggcccucagcaagcuggccuccgagcugagcaacacguucggcgccaucuccgccagcaucggcgacaucauccagcgccucgacgugcuggagcaggacgcgcagaucgaccggcugaucaacgggcgccucaccacccugaacgccuucgucgcccagcagcuggugcgguccgagagcgccgcgcucuccgcccagcuggccaaggacaaggugaacgagugcgucaaggcccagagcaagcgcuccggcuucugcgggcagggcacccacaucgugagcuucgucgugaacgcccccaacggccuguacuucaugcacgugggguacuaccccuccaaccacaucgaggucgugagcgcguacggccucugcgacgccgccaaccccacgaacugcaucgccccggugaacggguacuucaucaagaccaacaacacccggaucgucgacgaguggagcuacaccggcuccagcuucuacgcccccgagcccaucacgucccugaacaccaaguacguggcgccccaggugaccuaccagaacaucagcaccaaccugccgccgccccuccuguccaacagcaccgggaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcugggcaacuacaccuacuacaacaaguggcccugguacaucuggcucggguucaucgccggccugguggcccuggcccucugcguguucuucauccugugcugcaccgggugcggcaccaacugcauggggaagcugaagugcaaccgcugcugcgaccgcuacgaggaguacgaccucgagccccacaaggugcacguccacuga

SEQ ID NO: 388 - RNA, 4062 nt, Artificial Sequence
  derived and/or modified CDS sequence (opt1) from MERS-CoV__ALS20350__S
augauccacagcguguuccugcucauguuccugcugacccccaccgaguccuacgucgacgugggcccggacagcgccaaguccgccugcaucgagguggacauccagcagacguucuucgacaagaccuggccccgccccaucgacgucagcaaggcggacgggaucaucuacccccagggccggaccuacuccaacaucaccaucacguaccagggccucuucccguaccagggcgaccacggggacauguacguguacagcgccggccacgccaccggcaccacgccccagaagcuguucguggccaacuacucccaggacgucaagcaguucgccaacggguucguggugcgcaucggcgcggccgccaacagcaccgggaccgucaucaucucccccagcaccuccgccaccauccggaagaucuaccccgcguucaugcugggcagcuccguggggaacuucagcgacggcaagaugggccgcuucuucaaccacacgcucgugcugcugccggacgggugcggcacccuccugcgggccuucuacugcauccuggagccccgcuccgggaacuacugccccgccggcaacagcuacaccuccuucgccaccuaccacacgcccgccaccgacugcagcgacggcaacuacaaccggaacgcgucccucaacagcuucaaggaguacuucaaccugcgcaacugcaccuucauguacaccuacaacaucacggaggacgagauccuggagugguucgggaucacccagaccgcccagggcguccaccucuucagcucccgguacguggaccuguacgggggcaacauguuccaguucgccacccugccgguguacgacacgaucaaguacuacagcaucaucccccacuccauccgcagcauccaguccgaccggaaggccugggccgcguucuacgucuacaagcuccagccccugaccuuccugcucgacuucagcguggacggguacauccgccgggccaucgacugcggcuucaacgaccugucccagcugcacugcagcuacgaguccuucgacguggagagcggcgucuacuccgugagcuccuucgaggccaagcccagcggguccguggucgagcaggccgagggcguggagugcgacuucagcccgcuccuguccgggaccccgccccagguguacaacuucaagcgccuggucuucaccaacugcaacuacaaccucacgaagcugcugagccucuucuccgugaacgacuucacgugcagccagaucagccccgccgcgaucgccuccaacugcuacagcucccugauccuggacuacuucagcuacccccucuccaugaaguccgaccugagcgucagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggugccccagcuggucaacgccaaccaguacagccccugcguguccaucgugcccagcacggucugggaggacggggacuacuaccggaagcagcucagcccgcuggagggcggcggguggcugguggcguccggcagcaccguggccaugaccgagcagcuccagaugggguucggcaucaccguccaguacgggaccgacacgaacuccgugugccccaagcuggaguucgccaacgacaccaagaucgccagccagcugggcaacugcguggaguacucccucuacggcgucagcgggcgcggcguguuccagaacugcaccgcgguggggguccggcagcagcgcuucguguacgacgccuaccagaaccuggugggcuacuacuccgacgacggcaacuacuacugccugcgggccugcgucaccgugcccgugagcgucaucuacgacaaggagacgaagacccacgccacccuguucggguccguggccugcgagcacaucagcuccaccaugagccaguacucccgcagcacgcgcuccaugcucaagcggcgcgacagcaccuacggcccgcugcagacccccguggggugcguccugggccucgugaacuccagccuguucguggaggacugcaagcugccccucgggcagucccugugcgcgcugcccgacaccccgagcacgcucacgccccggagcguccgcuccgugcccggcgagaugcggcuggccagcaucgccuucaaccaccccauccagguggaccagcugaacuccagcuacuucaagcucuccaucccgaccaacuucagcuucggcgucacccaggaguacauccagaccaccauccagaaggugaccguggacugcaagcaguacgucugcaacggguuccagaagugcgagcagcugcugcgcgaguacggccaguucugcuccaagaucaaccaggcccuccacggggccaaccugcggcaggacgacagcgugcgcaaccuguucgcguccgucaagagcuaccaguccagccccaucauccccggcuucgggggcgacuucaaccucacccugcuggagcccguguccaucagcacgggcucccggagcgcccgcuccgccaucgaggaccuccuguucgacaaggugaccaucgccgacccgggguacaugcagggcuacgacgacugcaugcaccaggggcccgccagcgcgcgggaccugaucugcgcccaguacguggccggcuacaagguccucccgccccugauggacgugaacauggaggccgcguacaccuccagccugcucgggagcaucgccggcgugggcuggaccgccgggcuguccagcuucgccgccauccccuucgcgcaguccaucuucuaccgccugaacggcgucgggaucacgcagcagguccucagcgagaaccagaagcugaucgccaacaaguucaaccaggcccugggcgccaugcagaccggguucaccaccacgaacgaggccuuccagaaggugcaggacgcggugaacaacaacgcccaggcccucuccaagcuggccagcgagcuguccaacaccuucggcgccaucagcgcguccaucggcgacaucauccagcggcucgacgugcuggagcaggacgcccagaucgaccgccugaucaacgggcggcucaccacccugaacgccuucguggcccagcagcugguccgcagcgaguccgcggcccucagcgcccagcuggccaaggacaaggugaacgagugcgugaaggcccaguccaagcggagcggcuucugcgggcagggcacgcacaucgucuccuucguggucaacgcgcccaacggccuguacuucaugcacgugggguacuaccccagcaaccacaucgagguggucuccgccuacggccucugcgaccuggccaaccccaccaacugcaucgccccggugaacggguacuucaucaagaccaacaacacccgcaucguggacgaguggagcuacacgggcuccagcuucuacgcccccgagcccaucaccagcuucaacaccaaguacgucgcgccccaggugaccuaccagaacaucuccaccaaccugccgccgccccuccuggggaacagcacgggcaucgacuuccaggacgagcuggacgaguucuucaagaacguguccaccagcauccccaacuucggcucccucacccagaucaacaccacgcugcuggaccucaccuacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcgucuucuucauccugugcugcaccggcugcgggacgaacugcaugggcaagcugaagugcaaccggugcugcgaccgcuacgaggaguacgaccucgagccccacaaggugcacgugcacuga

SEQ ID NO: 389 - RNA, 4062 nt, Artificial Sequence
  derived and/or modified CDS sequence (opt1) from MERS-CoV__ALT66880__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccagcgccucgacgugcuggagcaggacgcgcagaucgaccggcugaucaacgggcgccucaccacccugaacgccuucgucgcccagcagcuggugcggagcgaguccgccgcgcucagcgcccagcuggccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccggaucgucgacgaguggagcuacaccggcagcuccuucuacagccccgagcccaucacgucccugaacaccaaguacguggcgccccaggugaccuaccagaacaucagcaccaaccugccgccgccccuccuggggaacuccaccggcaucgacuuccaggacgagcuggacgaguucuucaagaacgucagcacguccauccccaacuucggcagccucacccagaucaacaccacccugcuggaccucacguacgagaugcugucccugcagcaggucgugaaggcccucaacgagagcuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 390 - RNA, 4062 nt, Artificial Sequence
  derived and/or modified CDS sequence (opt1) from MERS-CoV__ALA49341__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggggaccacggggacauguacguguacagcgcgggccacgccaccggcaccacccugcagaagcuguucgucgccaacuacucccaggacgugaagcaguucgccaacggguucgugguccgcaucggcgccgcggccaacagcacggggaccgugaucaucucccccagcaccuccgccaccauccggaagaucuaccccgccuucaugcucggcagcuccguggggaacuucagcgacggcaagaugggccgcuucuucaaccacacgcugguccugcuccccgacgggugcggcacccugcugcgggcguucuacugcauccucgagccgcgcuccgggaaccacugccccgccggcaacagcuacaccuccuucgccaccuaccacacgcccgccaccgacugcagcgacggcaacuacaaccggaacgccucccugaacagcuucaaggaguacuucaaccugcgcaacugcaccuucauguacaccuacaacaucacggaggacgagauccucgagugguucgggaucacccagaccgcgcagggcgugcaccuguucagcucccgguacguggaccuguacgggggcaacauguuccaguucgccacccuccccgucuacgacacgaucaaguacuacagcaucaucccgcacuccauccgcagcauccaguccgaccggaaggccugggccgccuucuacguguacaagcugcagccccugaccuuccuccuggacuucagcguggacggguacauccgccgggcgaucgacugcggcuucaacgaccugucccagcuccacugcagcuacgaguccuucgacgucgagagcggcguguacuccgugagcuccuucgaggccaagcccagcggguccgucguggagcaggccgagggcguggagugcgacuucagcccccugcuguccgggaccccgccccaggucuacaacuucaagcgccucguguucaccaacugcaacuacaaccugacgaagcugcucagccuguucuccgucaacgacuucaucugcagccagaucagccccgccgccaucgcguccaacugcuacagcucccugauccucgacuacuucagcuacccccuguccaugaaguccgaccugagcgugagcuccgccggcccgaucagccaguucaacuacaagcaguccuucagcaaccccacgugccucauccuggccaccgugccccacaaccugaccacgaucaccaagccccucaaguacuccuacaucaacaagugcagccggcugcuguccgacgaccgcaccgaggucccgcagcucgugaacgccaaccaguacagccccugcguguccaucguccccagcaccgugugggaggacggggacuacuaccggaagcagcugagcccccuggagggcggcggguggcucguggccuccggcagcacggucgcgaugaccgagcagcugcagaugggguucggcaucaccgugcaguacgggaccgacaccaacuccgugugcccgaagcuggaguucgccaacgacacgaagaucgccagccagcucggcaacugcgucgaguacucccuguacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacccacgccacccucuucgggagcguggccugcgagcacaucuccagcaccaugucccaguacagccgcuccacccgcagcaugcugaagcggcgcgacuccaccuacggcccccugcagacgccggucgggugcgugcucggccuggugaacagcucccuguucgucgaggacugcaagcucccccuggggcagagccugugcgcccuccccgacacccccagcacccugaccccgcgguccgugcgcagcgugcccggcgagaugcggcuggcguccaucgccuucaaccaccccauccaggucgaccagcucaacagcuccuacuucaagcugagcauccccacgaacuucuccuucggcgugacccaggaguacauccagaccaccauccagaaggugacggucgacugcaagcaguacgugugcaacggguuccagaagugcgagcagcugcuccgcgaguacggccaguucugcagcaagaucaaccaggcccugcacggggccaaccugcggcaggacgacuccgugcgcaaccucuucgccagcgucaaguccagccaguccagcccgaucauccccggcuucgggggcgacuucaaccugacccugcucgagcccguguccaucagcaccggcucccggagcgcgcgcuccgccaucgaggaccugcuguucgacaaggugaccaucgccgaccccggguacaugcagggcuacgacgacugcaugcagcaggggccggccagcgcccgggaccucaucugcgcgcaguacgucgccggcuacaaggugcugccgccccugauggacgugaacauggaggccgccuacacgagcucccuccuggggagcaucgcgggcgucggcuggaccgccgggcuguccagcuucgccgccauccccuucgcccaguccaucuucuaccgccucaacggcguggggaucacccagcagguccugagcgagaaccagaagcugaucgcgaacaaguucaaccaggcccucggcgccaugcagaccggguucacgaccaccaacgaggccuuccggaaggugcaggacgccgugaacaacaacgcgcaggcccuguccaagcuggccagcgagcucuccaacaccuucggcgccaucagcgccuccaucggcgacaucauccagcgccuggacgugcuggagcaggacgcgcagaucgaccggcucaucaacgggcgccugacgacccugaacgccuucgucgcccagcagcucgugcggagcgaguccgccgcgcugagcgcccagcuggccaaggacaaggugaacgagugcgucaaggcccaguccaagcgcagcggcuucugcgggcagggcacccacaucguguccuucgucgugaacgcccccaacggccucuacuucaugcacgugggguacuaccccagcaaccacaucgaggucguguccgcguacggccugugcgacgccgccaaccccaccaacugcaucgcccccgugaacggguacuucaucaagacgaacaacacccggaucgucgacgaguggagcuacaccggcagcuccuucuacgccccggagcccaucaccagccugaacacgaaguacguggcgccccaggugaccuaccagaacaucuccaccaaccugcccccgccccuccuggggaacagcaccggcaucgacuuccaggacgagcucgacgaguucuucaagaacgucuccaccagcauccccaacuucggcucccugacgcagaucaacaccacccugcucgaccugaccuacgagaugcugagccuccagcaggucgugaaggcccugaacgaguccuacaucgaccugaaggagcucgggaacuacacguacuacaacaaguggccgugguacaucuggcugggcuucaucgccgggcugguggcccucgcccugugcguguucuucauccugugcugcaccggcugcgggaccaacugcaugggcaagcucaagugcaaccgcugcugcgaccgcuacgaggaguacgaccuggagccccacaaggugcacguccacuga

SEQ ID NO: 391 - RNA, 4062 nt, Artificial Sequence
  derived and/or modified CDS sequence (opt1) from MERS-CoV__ALA49352__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuacuacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccagcgccucgacgugcuggagcaggacgcgcagaucgaccggcugaucaacgggcgccucaccacccugaacgccuucgucgcccagcagcuggugcggagcgaguccgccgcgcucagcgcccagcuggccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccggaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 392 - RNA, 4062 nt, Artificial Sequence
  derived and/or modified CDS sequence (opt1) from MERS-CoV__ALA49363__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccaccuucccggucuacgacacgaucaaguacuacagcaucaucccccacuccauccgcagcauccaguccgaccggaaggccugggccgccuucuacguguacaagcugcagccccucaccuuccugcuggacuucagcguggacggguacauccgccgggcgaucgacugcggcuucaacgaccucucccagcugcacugcagcuacgaguccuucgacgucgagagcggcguguacuccgugagcuccuucgaggccaagcccagcggguccgucguggagcaggccgagggcguggagugcgacuucagcccgcugcucuccgggaccccgccccaggucuacaacuucaagcgccugguguucaccaacugcaacuacaaccugacgaagcuccugagccuguucuccgucaacgacuucacgugcagccagaucagccccgccgccaucgcguccaacugcuacagcucccucauccuggacuacuucagcuacccccuguccaugaaguccgaccucagcgugagcuccgccgggcccaucagccaguucaacuacaagcaguccuucagcaacccgaccugccugauccuggccaccgugccccacaaccucaccaccaucaccaagccccugaaguacuccuacaucaacaagugcagccggcugcucuccgacgaccgcaccgaggucccccagcuggugaacgccaaccaguacagccccugcguguccaucguccccagcacggugugggaggacggggacuacuaccggaagcagcugagcccgcucgagggcggcggguggcugguggccuccggcagcaccgucgcgaugaccgagcagcugcagaugggguucggcaucaccgugcaguacgggaccgacacgaacuccgugugccccaagcucgaguucgccaacgacaccaagaucgccagccagcugggcaacugcgucgaguacucccuguacggcgugagcgggcgcggcguguuccagaacugcaccgccgucggggugcggcagcagcgcuucguguacgacgcguaccagaaccucgucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcugaagcggcgcgacuccacguacggcccgcuccagacccccgucgggugcgugcugggccuggugaacagcucccucuucgucgaggacugcaagcugccccuggggcagagccucugcgcccugcccgacaccccgagcacccugacgccccgguccgugcgcagcgugcccggcgagaugcggcucgcguccaucgccuucaaccaccccauccaggucgaccagcugaacagcuccuacuucaagcugagcaucccgaccaacuucuccuucggcgugacccaggaguacauccagaccacgauccagaaggugaccgucgacugcaagcaguacgugugcaacggguuccagaagugcgagcagcuccugcgcgaguacggccaguucugcagcaagaucaaccaggcccugcacggggccaaccuccggcaggacgacuccgugcgcaaccuguucgccagcgucaaguccagccaguccagccccaucauccccggcuucgggggcgacuucaaccugacccuccuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcugccgccccucauggacgugaacauggaggccgccuacaccagcucccugcuggggagcaucgcgggcgucggcuggaccgccgggcucuccagcuucgccgccauccccuucgcccaguccaucuucuaccgccugaacggcguggggaucacccagcagguccugagcgagaaccagaagcucaucgcgaacaaguucaaccaggcccugggcgccaugcagacgggguucaccaccaccaacgaggccuuccggaaggugcaggacgccgugaacaacaacgcgcaggcccuguccaagcucgccagcgagcuguccaacacguucggcgccaucagcgccuccaucggcgacaucauccagcgccuggacgugcucgagcaggacgcgcagaucgaccggcugaucaacgggcgccugaccacccucaacgccuucgucgcccagcagcuggugcggagcgaguccgccgcgcugagcgcccagcucgccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccugugcgacgccgccaaccccacgaacugcaucgccccggugaacggguacuucaucaagaccaacaacacccggaucgucgacgaguggagcuacaccggcagcuccuucuacgcccccgagcccaucacgagccucaacaccaaguacguggcgccccaggugaccuaccagaacaucuccaccaaccugccgccgccccugcucgggaacagcaccggcaucgacuuccaggacgagcuggacgaguucuucaagaacgucuccacgagcauccccaacuucggcucccugacccagaucaacaccacccuccuggaccugacguacgagaugcucagccugcagcaggucgugaaggcccugaacgaguccuacaucgaccucaaggagcuggggaacuacaccuacuacaacaaguggcccugguacaucuggcugggcuucaucgccgggcucguggcccuggcccugugcguguucuucauccucugcugcaccggcugcgggaccaacugcaugggcaagcugaagugcaaccgcugcugcgaccgcuacgaggaguacgaccuggagccccacaaggugcacguccacuga

SEQ ID NO: 393 - RNA, 4062 nt, Artificial Sequence
  derived and/or modified CDS sequence (opt1) from MERS-CoV__ALA49374__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaacuucacgaagcuccugagccuguucuccgucaacgacuucacgugcagccagaucagccccgccgccaucgcguccaacugcuacagcucccucauccuggacuacuucagcuacccccuguccaugaaguccgaccucagcgugagcuccgccgggcccaucagccaguucaacuacaagcaguccuucagcaacccgaccugccugauccuggccaccgugccccacaaccucaccaccaucaccaagccccugaaguacuccuacaucaacaagugcagccggcugcucuccgacgaccgcaccgaggucccccagcuggugaacgccaaccaguacagccccugcguguccaucguccccagcacggugugggaggacggggacuacuaccggaagcagcugagcccgcucgagggcggcggguggcugguggccuccggcagcaccgucgcgaugaccgagcagcugcagaugggguucggcaucaccgugcaguacgggaccgacacgaacuccgugugccccaagcucgaguucgccaacgacaccaagaucgccagccagcugggcaacugcgucgaguacucccuguacggcgugagcgggcgcggcguguuccagaacugcaccgccgucggggugcggcagcagcgcuucguguacgacgcguaccagaaccucgucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcugaagcggcgcgacuccacguacggcccgcuccagacccccgucgggugcgugcugggccuggugaacagcucccucuucgucgaggacugcaagcugccccuggggcagagccucugcgcccugcccgacaccccgagcacccugacgccccgguccgugcgcagcgugcccggcgagaugcggcucgcguccaucgccuucaaccaccccauccaggucgaccagcugaacagcuccuacuucaagcugagcaucccgaccaacuucuccuucggcgugacccaggaguacauccagaccacgauccagaaggugaccgucgacugcaagcaguacgugugcaacggguuccagaagugcgagcagcuccugcgcgaguacggccaguucugcagcaagaucaaccaggcccugcacggggccaaccuccggcaggacgacuccgugcgcaaccuguucgccagcgucaaguccagccaguccagccccaucauccccggcuucgggggcgacuucaaccugacccuccuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcugccgccccucauggacgugaacauggaggccgccuacaccagcucccugcuggggagcaucgcgggcgucggcuggaccgccgggcucuccagcuucgccgccauccccuucgcccaguccaucuucuaccgccugaacggcguggggaucacccagcagguccugagcgagaaccagaagcucaucgcgaacaaguucaaccaggcccugggcgccaugcagacgggguucaccaccaccaacgaggccuuccggaaggugcaggacgccgugaacaacaacgcgcaggcccuguccaagcucgccagcgagcuguccaacacguucggcgccaucagcgccuccaucggcgacaucauccagcgccuggacgugcucgagcaggacgcgcagaucgaccggcugaucaacgggcgccugaccacccucaacgccuucgucgcccagcagcuggugcggagcgaguccgccgcgcugagcgcccagcucgccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccugugcgacgccgccaaccccacgaacugcaucgccccggugaacggguacuucaucaagaccaacaacacccggaucgucgacgaguggagcuacaccggcagcuccuucuacgcccccgagcccaucacgagccucaacaccaaguacguggcgccccaggugaccuaccagaacaucuccaccaaccugccgccgccccugcucagcaacuccaccgggaucgacuuccaggacgagcuggacgaguucuucaagaacgucagcacguccauccccaacuucggcagccugacccagaucaacaccacccuccuggaccugacguacgagaugcucucccugcagcaggucgugaaggcccugaacgagagcuacaucgaccucaaggagcugggcaacuacaccuacuacaacaaguggcccugguacaucuggcugggguucaucgccggccucguggcccuggcccugugcguguucuucauccucugcugcaccgggugcggcaccaacugcauggggaagcugaagugcaaccgcugcugcgaccgcuacgaggaguacgaccuggagccccacaaggugcacguccacuga

SEQ ID NO: 394 - RNA, 4062 nt, Artificial Sequence
  derived and/or modified CDS sequence (opt1) from MERS-CoV__ALA49396__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccagcuccaacccgaccugccugauccucgccaccgugccccacaaccugaccaccaucaccaagccccugaaguacagcuacaucaacaagugcucccggcuccugagcgacgaccgcaccgaggucccccagcuggugaacgccaaccaguacucccccugcgugagcaucguccccagcacggugugggaggacggggacuacuaccggaagcagcucuccccgcuggagggcggcggguggcugguggccagcggcuccaccgucgcgaugaccgagcagcuccagaugggguucggcaucaccgugcaguacgggaccgacacgaacagcgugugccccaagcuggaguucgccaacgacaccaagaucgccucccagcugggcaacugcgucgaguacagccucuacggcguguccgggcgcggcguguuccagaacugcaccgccgucggggugcggcagcagcgcuucguguacgacgcguaccagaaccuggucggcuacuacagcgacgacggcaacuacuacugccugcgggccugcguguccgugcccgucagcgugaucuacgacaaggagaccaagacgcacgccacccuguucggguccguggccugcgagcacaucagcuccaccaugagccaguacucccgcagcacccgcuccaugcucaagcggcgcgacagcacguacggcccgcugcagacccccgucgggugcgugcugggccucgugaacuccagccuguucgucgaggacugcaagcugccccucgggcagagccugugcgcccugcccgacaccccguccacccucacgccccggagcgugcgcuccgugcccggcgagaugcggcuggcgagcaucgccuucaaccaccccauccaggucgaccagcugaacuccagcuacuucaagcucuccaucccgaccaacuucagcuucggcgugacccaggaguacauccagaccacgauccagaaggugaccgucgacugcaagcaguacgugugcaacggguuccagaagugcgagcagcugcugcgcgaguacggccaguucugcuccaagaucaaccaggcccuccacggggccaaccugcggcaggacgacagcgugcgcaaccuguucgccuccgucaagagcucccagagcucccccaucauccccggcuucgggggcgacuucaaccucacccugcuggagcccgugagcaucuccaccggcagccgguccgcgcgcagcgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccuccagccugcucggguccaucgcgggcgucggcuggaccgccgggcugagcuccuucgccgccauccccuucgcccagagcaucuucuaccgccugaacggcguggggaucacccagcagguccucuccgagaaccagaagcugaucgcgaacaaguucaaccaggcccugggcgccaugcagacgggguucaccaccaccaacgaggccuuccggaaggugcaggacgccgugaacaacaacgcgcaggcccucagcaagcuggccuccgagcugagcaacacguucggcgccaucuccgccagcaucggcgacaucauccagcgccucgacgugcuggagcaggacgcgcagaucgaccggcugaucaacgggcgccucaccacccugaacgccuucgucgcccagcagcuggugcgguccgagagcgccgcgcucuccgcccagcuggccaaggacaaggugaacgagugcgucaaggcccagagcaagcgcuccggcuucugcgggcagggcacccacaucgugagcuucgucgugaacgcccccaacggccuguacuucaugcacgugggguacuaccccuccaaccacaucgaggucgugagcgcguacggccucugcgacgccgccaaccccacgaacugcaucgccccggugaacggguacuucaucaagaccaacaacacccggaucgucgacgaguggagcuacaccggcuccagcuucuacgcccccgagcccaucacgucccugaacaccaaguacguggcgccccaggugaccuaccagaacaucagcaccaaccugccgccgccccuccuguccaacagcaccgggaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcugggcaacuacaccuacuacaacaaguggcccugguacaucuggcucggguucaucgccggccugguggcccuggcccucugcguguucuucauccugugcugcaccgggugcggcaccaacugcauggggaagcugaagugcaaccgcugcugcgaccgcuacgaggaguacgaccucgagccccacaaggugcacguccacuga

SEQ ID NO: 395 - RNA, 4062 nt, Artificial Sequence
  derived and/or modified CDS sequence (opt1) from MERS-CoV__ALA49451__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaaccugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccagcgccucgacgugcuggagcaggacgcgcagaucgaccggcugaucaacgggcgccucaccacccugaacgccuucgucgcccagcagcuggugcggagcgaguccgccgcgcucagcgcccagcuggccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccggaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 396 - RNA, 4062 nt, Artificial Sequence
  derived and/or modified CDS sequence (opt1) from MERS-CoV__ALA49473__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccaccaccgacugcagcgacggcaacuacaaccggaacgccucccucaacagcuucaaggaguacuucaaccugcgcaacugcaccuucauguacacguacaacaucaccgaggacgagauccuggagugguucgggaucacccagaccgcccagggcgugcaccucuucagcucccgguacguggaccuguacgggggcaacauguuccaguucgcgacgcugccggucuacgacaccaucaaguacuacagcaucaucccccacuccauccgcagcauccaguccgaccggaaggccugggccgccuucuacguguacaagcuccagccccugaccuuccugcucgacuucagcguggacggguacauccgccgggccaucgacugcggcuucaacgaccugucccagcugcacugcagcuacgaguccuucgacgucgagagcggcguguacuccgugagcuccuucgaggcgaagcccagcggguccgucguggagcaggccgagggcguggagugcgacuucagcccgcuccuguccgggaccccgccccaggucuacaacuucaagcgccugguguucacgaacugcaacuacaaccucaccaagcugcugagccucuucuccgucaacgacuucacgugcagccagaucagccccgccgccaucgccuccaacugcuacagcucccugauccuggacuacuucagcuacccccucuccaugaaguccgaccugagcgugagcuccgcggggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcacggaggucccccagcuggugaacgccaaccaguacagccccugcguguccaucguccccagcaccgugugggaggacggggacuacuaccggaagcagcucagcccgcuggagggcggcggguggcugguggccuccggcagcaccgucgccaugaccgagcagcuccagaugggguucggcaucaccgugcaguacgggacggacaccaacuccgugugccccaagcuggaguucgcgaacgacaccaagaucgccagccagcugggcaacugcgucgaguacucccucuacggcgugagcgggcgcggcguguuccagaacugcaccgccgucggggugcggcagcagcgcuucguguacgacgccuaccagaaccuggucggcuacuacuccgacgacggcaacuacuacugccugcgggcgugcgugagcgugcccgucuccgugaucuacgacaaggagacgaagacccacgccacccuguucgggagcguggccugcgagcacaucuccagcaccaugucccaguacagccgcuccacgcgcagcaugcucaagcggcgcgacuccaccuacggcccgcugcagacccccgucgggugcgugcugggccucgugaacagcucccuguucgucgaggacugcaagcugccccucgggcagagccugugcgcccugcccgacaccccgagcacgcucacgccccgguccgugcgcagcgugcccggcgagaugcggcuggccuccaucgcguucaaccaccccauccaggucgaccagcugaacagcuccuacuucaagcucagcaucccgaccaacuucuccuucggcgugacccaggaguacauccagaccaccauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcacgggcucccggagcgcccgcuccgcgaucgaggaccuccuguucgacaaggugaccaucgccgacccgggguacaugcagggcuacgacgacugcaugcagcaggggcccgccagcgcccgggaccugaucugcgcccaguacgucgcgggcuacaaggugcucccgccccugauggacgugaacauggaggccgccuacaccagcucccugcucgggagcaucgccggcgucggcuggaccgcggggcuguccagcuucgccgccauccccuucgcccaguccaucuucuaccgccugaacggcguggggaucacgcagcagguccucagcgagaaccagaagcugaucgccaacaaguucaaccaggcgcugggcgccaugcagaccggguucaccaccacgaacgaggccuuccggaaggugcaggacgccgugaacaacaacgcccaggcgcucuccaagcuggccagcgagcuguccaacaccuucggcgccaucagcgccuccaucggcgacaucauccagcgccucgacgugcuggagcaggacgcccagaucgaccggcugaucaacgggcgccucaccacccugaacgcguucgucgcccagcagcuggugcggagcgaguccgccgcccucagcgcgcagcuggccaaggacaaggugaacgagugcgucaaggcccaguccaagcgcagcggcuucugcgggcagggcacgcacaucguguccuucgucgugaacgcccccaacggccuguacuucaugcacgugggguacuaccccagcaaccacaucgaggucguguccgccuacggccucugcgacgcggccaaccccaccaacugcaucgccccggugaacggguacuucaucaagaccaacaacacccggaucgucgacgaguggagcuacacgggcagcuccuucuacgcccccgagcccaucaccagccugaacaccaaguacguggcgccccaggugaccuaccagaacaucuccaccaaccugccgccgccccuccuggggaacagcacgggcaucgacuuccaggacgagcuggacgaguucuucaagaacgucuccaccagcauccccaacuucggcucccucacccagaucaacaccacgcugcuggaccucaccuacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggacgaacugcaugggcaagcugaaguucaaccgcugcugcgaccgcuacgaggaguacgaccucgagccccacaaggugcacguccacuga

SEQ ID NO: 397 - RNA, 4062 nt, Artificial Sequence
  derived and/or modified CDS sequence (opt1) from MERS-CoV__ALA49583__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccagcgccucgacgugcuggagcaggacgcgcagaucgaccggcugaucaacgggcgccucaccacccugaacgccuucgucgcccagcagcuggugcggagcgaguccgccgcgcucagcgcccagcuggccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccggaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaaguucaaccgcugcugcgaccgcuacgaggaguacgaccucgagccccacaaggugcacguccacuga

SEQ ID NO: 398 - RNA, 4062 nt, Artificial Sequence
  derived and/or modified CDS sequence (opt1) from MERS-CoV__ALA49649__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacccccaagaagcuguucgucgccaacuacucccaggacgugaagcaguucgccaacggguucgugguccgcaucggcgccgcggccaacagcacggggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccauccccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccacaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccagcgccucgacgugcuggagcaggacgcgcagaucgaccggcugaucaacgggcgccucaccacccugaacgccuucgucgcccagcagcuggugcggagcgaguccgccgcgcucagcgcccagcuggccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccggaucgucgacgaguggagcuacaccggcagcuccuucuacgcccccgagcccaucacgagccugaacaccaaguacguggcgccccaggugaccuaccagaacaucuccaccaaccugccgccgccccuccugagcaacuccaccgggaucgacuuccaggacgagcuggacgaguucuucaagaacgucagcacguccauccccaacuucggcagccucacccagaucaacaccacccugcuggaccucacguacgagaugcugucccugcagcaggucgugaaggcccucaacgagagcuacaucgaccugaaggagcugggcaacuacaccuacuacaacaaguggcccugguacaucuggcucggguucaucgccggccugguggcccuggcccucugcguguucuucauccugugcugcaccgggugcggcaccaacugcauggggaagcugaagugcaaccgcugcugcgaccgcuacgaggaguacgaccucgagccccacaaggugcacguccacuga

SEQ ID NO: 399 - RNA, 4062 nt, Artificial Sequence
  derived and/or modified CDS sequence (opt1) from MERS-CoV__ALA49660__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaaguucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgacaaccagaagcugaucgcgaacaaguucaaccaggcccugggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccagcgccucgacgugcuggagcaggacgcgcagaucgaccggcugaucaacgggcgccucaccacccugaacgccuucgucgcccagcagcuggugcggagcgaguccgccgcgcucagcgcccagcuggccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccggaucgucgacgaguggagcuacaccggcagcuccuucuacgcccccgagcccaucacgagccugaacaccaaguacguggcgccccaggugaccuaccagaacaucuccaccaaccugccgccgccccuccugagcaacuccaccgggaucgacuuccaggacgagcuggacgaguucuucaagaacgucagcacguccauccccaacuucggcagccucacccagaucaacaccacccugcuggaccucacguacgagaugcugucccugcagcaggucgugaaggcccucaacgagagcuacaucgaccugaaggagcugggcaacuacaccuacuacaacaaguggcccugguacaucuggcucggguucaucgccggccugguggcccuggcccucugcguguucuucauccugugcugcaccgggugcggcaccaacugcauggggaagcugaagugcaaccgcugcugcgaccgcuacgaggaguacgaccucgagccccacaaggugcacguccacuga

SEQ ID NO: 400 - RNA, 4062 nt, Artificial Sequence
  derived and/or modified CDS sequence (opt1) from MERS-CoV__ALA49671__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccaacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgacaaccagaagcugaucgcgaacaaguucaaccaggcccugggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccagcgccucgacgugcuggagcaggacgcgcagaucgaccggcugaucaacgggcgccucaccacccugaacgccuucgucgcccagcagcuggugcggagcgaguccgccgcgcucagcgcccagcuggccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccggaucgucgacgaguggagcuacaccggcagcuccuucuacgcccccgagcccaucacgagccugaacaccaaguacguggcgccccaggugaccuaccagaacaucuccaccaaccugccgccgccccuccugagcaacuccaccgggaucgacuuccaggacgagcuggacgaguucuucaagaacgucagcacguccauccccaacuucggcagccucacccagaucaacaccacccugcuggaccucacguacgagaugcugucccugcagcaggucgugaaggcccucaacgagagcuacaucgaccugaaggagcugggcaacuacaccuacuacaacaaguggcccugguacaucuggcucggguucaucgccggccugguggcccuggcccucugcguguucuucauccugugcugcaccgggugcggcaccaacugcauggggaagcugaagugcaaccgcugcugcgaccgcuacgaggaguacgaccucgagccccacaaggugcacguccacuga

SEQ ID NO: 401 - RNA, 4062 nt, Artificial Sequence
  derived and/or modified CDS sequence (opt1) from MERS-CoV__ALA49682__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccagcgccucgacgugcuggagcaggacgcgcagaucgaccggcugaucaacgggcgccucaccacccugaacgccuucgucgcccagcagcuggugcggagcgaguccgccgcgcucagcgcccagcuggccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccggaucgucgacgaguggagcuacaccggcagcuccuucuacgcccccgagcccaucacgagccugaacaccaaguacguggcgccccaggugaccuaccagaacaucuccaccaaccugccgccgccccuccugagcaacuccaccgggaucgacuuccaggacgagcuggacgaguucuucaagaacgucagcacguccauccccaacuucggcagccucacccagaucaacaccacccugcuggaccucacguacgagaugcugucccugcagcaggucgugaaggcccucaacgagagcuacaucgaccugaaggagcugggcaacuacaccuacuacaacaaguggcccugguacaucuggcucggguucaucgccggccugguggcccuggcccucugcguguucuucauccugugcugcaccgggugcggcaccaacugcauggggaagcugaagugcaaccgcugcugcgaccgcuacgaggaguacgaccucgagccccacaaggugcacguccacuga

SEQ ID NO: 402 - RNA, 4062 nt, Artificial Sequence
  derived and/or modified CDS sequence (opt1) from MERS-CoV__ALA49803__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggaccgcuacguguacagcgcgggccacgccaccggcaccacgccccagaagcuguucgucgccaacuacucccaggacgugaagcaguucgccaacggguucgugguccggaucggcgccgcggccaacagcaccgggaccgugaucaucucccccagcaccuccgccaccauccgcaagaucuaccccgccuucaugcugggcagcuccguggggaacuucagcgacggcaagaugggccgguucuucaaccacacgcucguccugcugccggacgggugcggcacccuccugcgcgcguucuacugcauccuggagccccgguccgggaaccacugccccgccggcaacagcuacaccuccuucgccaccuaccacacgcccagcaccgacugcuccgacggcaacuacaaccgcaacgccagccucaacagcuucaaggaguacuucaaccugcggaacugcaccuucauguacaccuacaacaucacggaggacgagauccuggagugguucgggaucacccagaccgcccagggcgugcaccucuucuccagccgcuacguggaccuguacgggggcaacauguuccaguucgcgacccugccggucuacgacacgaucaaguacuacuccaucaucccccacagcauccgguccauccagagcgaccgcaaggccugggccgccuucuacguguacaagcuccagccccugaccuuccugcucgacuucuccguggacggguacauccggcgcgccaucgacugcggcuucaacgaccugagccagcugcacugcuccuacgagagcuucgacgucgaguccggcguguacagcguguccagcuucgaggcgaagcccuccgggagcgucguggagcaggccgagggcguggagugcgacuucuccccgcuccugagcgggaccccgccccaggucuacaacuucaagcggcugguguucaccaacugcaacuacaaccucacgaagcugcugucccucuucagcgucaacgacuucacgugcagccagaucucccccgccgccaucgccagcaacugcuacuccagccugauccuggacuacuucuccuacccccucagcaugaaguccgaccugagcguguccagcgcggggcccaucucccaguucaacuacaagcagagcuucuccaacccgaccugccugauccucgccaccgugccccacaaccugaccaccaucaccaagccccugaaguacagcuacaucaacaagugcucccgccuccugagcgacgaccggaccgaggucccccagcuggugaacgccaaccaguacucccccugcgugagcaucguccccagcacggugugggaggacggggacuacuaccgcaagcagcucuccccgcuggagggcggcggguggcugguggccagcggcuccaccgucgccaugaccgagcagcuccagaugggguucggcaucaccgugcaguacgggaccgacacgaacagcgugugccccaagcuggaguucgcgaacgacaccaagaucgccucccagcugggcaacugcgucgaguacagccucuacggcguguccgggcggggcguguuccagaacugcaccgccgucggggugcgccagcagcgguucguguacgacgccuaccagaaccuggucggcuacuacagcgacgacggcaacuacuacugccugcgcgcgugcguguccgugcccgucagcgugaucuacgacaaggagaccaagacgcacgccacccuguucggguccguggccugcgagcacaucagcuccaccaugagccaguacucccgcagcacccgguccaugcucaagcgccgggacagcacguacggcccgcugcagacccccgucgggugcgugcugggccucgugaacuccagccuguucgucgaggacugcaagcugccccucgggcagagccugugcgcccugcccgacaccccguccacccucacgccccgcagcgugcgguccgugcccggcgagaugcgccuggccagcaucgcguucaaccaccccauccaggucgaccagcugaacuccagcuacuucaagcucuccaucccgaccaacuucagcuucggcgugacccaggaguacauccagaccacgauccagaaggugaccgucgacugcaagcaguacgugugcaacggguuccagaagugcgagcagcugcugcgggaguacggccaguucugcuccaagaucaaccaggcccuccacggggccaaccugcgccaggacgacagcgugcggaaccuguucgccuccgucaagagcucccagagcucccccaucauccccggcuucgggggcgacuucaaccucacccugcuggagcccgugagcaucuccaccggcagccgcuccgcccggagcgcgaucgaggaccuccuguucgacaaggugacgaucgccgacccgggguacaugcagggcuacgacgacugcaugcagcaggggcccgccagcgcccgcgaccugaucugcgcccaguacgucgcgggcuacaaggugcucccgccccugauggacgugaacauggaggccgccuacaccuccagccugcucggguccaucgccggcgucggcuggaccgcggggcugagcuccuucgccgccauccccuucgcccagagcaucuucuaccggcugaacggcguggggaucacccagcagguccucuccgagaaccagaagcugaucgccaacaaguucaaccaggcgcugggcgccaugcagacgggguucaccaccaccaacgaggccuuccgcaaggugcaggacgccgugaacaacaacgcccaggcgcucagcaagcuggccuccgagcugagcaacacguucggcgccaucuccgccagcaucggcgacaucauccagcggcucgacgugcuggagcaggacgcccagaucgaccgccugaucaacgggcggcucaccacccugaacgcguucgucgcccagcagcuggugcgcuccgagagcgccgcccucuccgcgcagcuggccaaggacaaggugaacgagugcgucaaggcccagagcaagcgguccggcuucugcgggcagggcacccacaucgugagcuucgucgugaacgcccccaacggccuguacuucaugcacgugggguacuaccccuccaaccacaucgaggucgugagcgccuacggccucugcgacgcggccaaccccacgaacugcaucgccccggugaacggguacuucaucaagaccaacaacacccgcgucguggacgaguggagcuacaccggcuccagcuucuacgcccccgagcccaucacgucccugaacaccaaguacguggcgccccaggucaccuaccagaacaucagcaccaaccugccgccgccccuccuguccaacagcaccgggaucgacuuccaggacgagcuggacgaguucuucaagaacguguccacgagcauccccaacuucggcucccucacccagaucaacaccacccugcuggaccucacguacgagaugcugagccugcagcaggucgugaaggcccucaacgaguccuacaucgaccugaaggagcugggcaacuacaccuacuacaacaaguggcccugguacaucuggcucggguucaucgccggccugguggcccuggcccucugcguguucuucauccugugcugcaccgggugcggcaccaacugcauggggaagcugaagugcaaccgcugcugcgaccgguacgaggaguacgaccucgagccccacaagguccacgugcacuga

SEQ ID NO: 403 - RNA, 4062 nt, Artificial Sequence
  derived and/or modified CDS sequence (opt1) from MERS-CoV__ALA49836__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccagcuccaacccgaccugccugauccucgccaccgugccccacaaccugaccaccaucaccaagccccugaaguacagcuacaucaacaagugcucccggcuccugagcgacgaccgcaccgaggucccccagcuggugaacgccaaccaguacucccccugcgugagcaucguccccagcacggugugggaggacggggacuacuaccggaagcagcucuccccgcuggagggcggcggguggcugguggccagcggcuccaccgucgcgaugaccgagcagcuccagaugggguucggcaucaccgugcaguacgggaccgacacgaacagcgugugccccaagcuggaguucgccaacgacaccaagaucgccucccagcugggcaacugcgucgaguacagccucuacggcguguccgggcgcggcguguuccagaacugcaccgccgucggggugcggcagcagcgcuucguguacgacgcguaccagaaccuggucggcuacuacagcgacgacggcaacuacuacugccugcgggccugcguguccgugcccgucagcgugaucuacgacaaggagaccaagacgcacgccacccuguucggguccguggccugcgagcacaucagcuccaccaugagccaguacucccgcagcacccgcuccaugcucaagcggcgcgacagcacguacggcccgcugcagacccccgucgggugcgugcugggccucgugaacuccagccuguucgucgaggacugcaagcugccccucgggcagagccugugcgcccugcccgacaccccguccacccucacgccccggagcgugcgcuccgugcccggcgagaugcggcuggcgagcaucgccuucaaccaccccauccaggucgaccagcugaacuccagcuacuucaagcucuccaucccgaccaacuucagcuucggcgugacccaggaguacauccagaccacgauccagaaggugaccgucgacugcaagcaguacgugugcaacggguuccagaagugcgagcagcugcugcgcgaguacggccaguucugcuccaagaucaaccaggcccuccacggggccaaccugcggcaggacgacagcgugcgcaaccuguucgccuccgucaagagcucccagagcucccccaucauccccggcuucgggggcgacuucaaccucacccugcuggagcccgugagcaucuccaccggcagccgguccgcgcgcagcgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccuccagccugcucggguccaucgcgggcgucggcuggaccgccgggcugagcuccuucgccgccauccccuucgcccagagcaucuucuaccgccugaacggcguggggaucacccagcagguccucuccgagaaccagaagcugaucgcgaacaaguucaaccaggcccugggcgccaugcagacgggguucaccaccaccaacgaggccuuccggaaggugcaggacgccgugaacaacaacgcgcaggcccucagcaagcuggccuccgagcugagcaacacguucggcgccaucuccgccagcaucggcgacaucauccagcgccucgacgugcuggagcaggacgcgcagaucgaccggcugaucaacgggcgccucaccacccugaacgccuucgucgcccagcagcuggugcgguccgagagcgccgcgcucuccgcccagcuggccaaggacaaggugaacgagugcgucaaggcccagagcaagcgcuccggcuucugcgggcagggcacccacaucgugagcuucgucgugaacgcccccaacggccuguacuucaugcacgugggguacuaccccuccaaccacaucgaggucgugagcgcguacggccucugcgacgccgccaaccccacgaacugcaucgccccggugaacggguacuucaucaagaccaacaacacccggaucgucgacgaguggagcuacaccggcuccagcuucuacgcccccgagcccaucacgucccugaacaccaaguacguggcgccccaggugaccuaccagaacaucagcaccaaccugccgccgccccuccuggggaacuccaccggcaucgacuuccaggacgagcuggacgaguucuucaagaacgucagcacguccauccccaacuucggcagccucacccagaucaacaccacccugcuggaccucacguacgagaugcugucccugcagcaggucgugaaggcccucaacgagagcuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 404 - RNA, 4062 nt, Artificial Sequence
  derived and/or modified CDS sequence (opt1) from MERS-CoV__ALA49957__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccagcgccucgacgugcuggagcaggacgcgcagaucgaccggcugaucaacgggcgccucaccacccugaacgccuucgucgcccagcagcuggugcggagcgaguccgccgcgcucagcgcccagcuggccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacaccaccaucgucgacgaguggagcuacacgggcagcuccuucuacgcccccgagcccaucaccagccugaacaccaaguacguggcgccccaggugaccuaccagaacaucuccaccaaccugccgccgccccuccuggggaacagcacgggcaucgacuuccaggacgagcuggacgaguucuucaagaacgucuccaccagcauccccaacuucggcucccucacccagaucaacaccacgcugcuggaccucaccuacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggacgaacugcaugggcaagcugaagugcaaccggugcugcgaccgcuacgaggaguacgaccucgagccccacaaggugcacguccacuga

SEQ ID NO: 405 - RNA, 4062 nt, Artificial Sequence
  derived and/or modified CDS sequence (opt1) from MERS-CoV__ALA50067__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccagcgggcccaucucccaguucaacuacaagcagagcuucuccaacccgaccugccugauccucgccaccgugccccacaaccugaccaccaucaccaagccccugaaguacagcuacaucaacaagugcucccggcuccugagcgacgaccgcaccgaggucccccagcuggugaacgccaaccaguacucccccugcgugagcaucguccccagcacggugugggaggacggggacuacuaccggaagcagcucuccccgcuggagggcggcggguggcugguggccagcggcuccaccgucgccaugaccgagcagcuccagaugggguucggcaucaccgugcaguacgggaccgacacgaacagcgugugccccaagcuggaguucgcgaacgacaccaagaucgccucccagcugggcaacugcgucgaguacagccucuacggcguguccgggcgcggcguguuccagaacugcaccgccgucggggugcggcagcagcgcuucguguacgacgccuaccagaaccuggucggcuacuacagcgacgacggcaacuacuacugccugcgggcgugcguguccgugcccgucagcgugaucuacgacaaggagaccaagacgcacgccacccuguucggguccguggccugcgagcacaucagcuccaccaugagccaguacucccgcagcacccgcuccaugcucaagcggcgcgacagcacguacggcccgcugcagacccccgucgggugcgugcugggccucgugaacuccagccuguucgucgaggacugcaagcugccccucgggcagagccugugcgcccugcccgacaccccguccacccucacgccccggagcgugcgcuccgugcccggcgagaugcggcuggccagcaucgcguucaaccaccccauccaggucgaccagcugaacuccagcuacuucaagcucuccaucccgaccaacuucagcuucggcgugacccaggaguacauccagaccacgauccagaaggugaccgucgacugcaagcaguacgugugcaacggguuccagaagugcgagcagcugcugcgcgaguacggccaguucugcuccaagaucaaccaggcccuccacggggccaaccugcggcaggacgacagcgugcgcaaccuguucgccuccgucaagagcucccagagcucccccaucauccccggcuucgggggcgacuucaaccucacccugcuggagcccgugagcaucuccaccggcagccgguccgcccgcagcgcgaucgaggaccuccuguucgacaaggugacgaucgccgacccgggguacaugcagggcuacgacgacugcaugcagcaggggcccgccagcgcccgggaccugaucugcgcccaguacgucgcgggcuacaaggugcucccgccccugauggacgugaacauggaggccgccuacaccuccagccugcucggguccaucgccggcgucggcuggaccgcggggcugagcuccuucgccgccauccccuucgcccagagcaucuucuaccgccugaacggcguggggaucacccagcagguccucuccgagaaccagaagcugaucgccaacaaguucaaccaggcgcugggcgccaugcagacgggguucaccaccaccaacgaggccuuccggaaggugcaggacgccgugaacaacaacgcccaggcgcucagcaagcuggccuccgagcugagcaacacguucggcgccaucuccgccagcaucggcgacaucauccagcgccucgacgugcuggagcaggacgcccagaucgaccggcugaucaacgggcgccucaccacccugaacgcguucgucgcccagcagcuggugcgguccgagagcgccgcccucuccgcgcagcuggccaaggacaaggugaacgagugcgucaaggcccagagcaagcgcuccggcuucugcgggcagggcacccacaucgugagcuucgucgugaacgcccccaacggccuguacuucaugcacgugggguacuaccccuccaaccacaucgaggucgugagcgccuacggccucugcgacgcggccaaccccacgaacugcaucgccccggugaacggguacuucaucaagaccaacaacacccggaucgucgacgaguggagcuacaccggcuccagcuucuacgcccccgagcccaucacgucccugaacaccaaguacguggcgccccaggugaccuaccagaacaucagcaccaaccugccgccgccccuccuguccaacagcaccgggaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcugggcaacuacaccuacuacaacaaguggcccugguacaucuggcucggguucaucgccggccugguggcccuggcccucugcguguucuucauccugugcugcaccgggugcggcaccaacugcauggggaagcugaagugcaaccgcugcugcgaccgcuacgaggaguacgaccucgagccccacaaggugcacguccacuga

SEQ ID NO: 406 - RNA, 249 nt, Artificial Sequence
  derived and/or modified CDS sequence (opt1) from MERS-CoV__AGH58723__E
augcugcccuucgugcaggagcgcaucggccucuucaucgucaacuucuucaucuucaccguggugugcgccaucacccugcuggucugcauggccuuccucacggcgacccggcugugcgugcagugcaugaccggguucaacacccugcucgugcagcccgcccuguaccuguacaacacgggccgcagcgucuacgugaaguuccaggacuccaagccgccccucccgcccgacgaguggguguga

SEQ ID NO: 407 - RNA, 249 nt, Artificial Sequence
  derived and/or modified CDS sequence (opt1) from MERS-CoV__AGV08472__E
augcugcccuucgugcaggagcgcgucggccucuucaucgugaacuucuucaucuucaccguggucugcgccaucacccugcuggugugcauggccuuccucacggcgacccggcugugcgugcagugcaugaccggguucaacacccugcucguccagcccgcccuguaccuguacaacacgggccgcagcguguacgugaaguuccaggacuccaagccgccccucccgcccgacgagugggucuga

SEQ ID NO: 408 - RNA, 249 nt, Artificial Sequence
  derived and/or modified CDS sequence (opt1) from MERS-CoV__AGV08540__E
augcugcccuucgugcaggagcgcaucggccucuucaucgucaaguucuucaucuucaccguggugugcgccaucacccugcuggucugcauggccuuccucacggcgacccggcugugcgugcagugcaugaccggguucaacacccugcucgugcagcccgcccuguaccuguacaacacgggccgcagcgucuacgugaaguuccaggacuccaagccgccccucccgcccgacgaguggguguga

SEQ ID NO: 409 - RNA, 249 nt, Artificial Sequence
  derived and/or modified CDS sequence (opt1) from MERS-CoV__ALX27237__E
augcugcccuucgugcaggagcgcaucggccucuucaucgucaacuucuucaucuucaccguggugugcgccaucacccugcuggucugcauggccuuccucacggcgacccggcugugcgugcagugcaugaccggguucaacacccugcucgugcagcccgcccuguaccuguacaacacgggccgcagcgucuacgugaaguuccaggacuccaagccgccccuccccagcgacgaguggguguga

SEQ ID NO: 410 - RNA, 249 nt, Artificial Sequence
  derived and/or modified CDS sequence (opt1) from MERS-CoV__ALR69646__E
augcugcccuucgugcaggagcgcaucggccucuucaucgucaacuucuucaucuucaccguggugugcgccaucacccugcuggucugcauggccuuccucacggcgacccggcugugcgugcagugcaucaccggguucaacacccugcucgugcagcccgcccuguaccuguacaacacgggccgcagcgucuacgugaaguuccaggacuccaagccgccccucccgcccgacgaguggguguga

SEQ ID NO: 411 - RNA, 249 nt, Artificial Sequence
  derived and/or modified CDS sequence (opt1) from MERS-CoV__ALA49346__E
augcugcccuucgugcaggagcgcaucggccucuucaucgucaacuucagcaucuucaccguggugugcgccaucacccugcuggucugcauggccuuccucacggcgacccggcugugcgugcagugcaugaccggguucaacacccugcucgugcagcccgcccuguaccuguacaacacgggccgcuccgucuacgugaaguuccaggacagcaagccgccccucccgcccgacgaguggguguga

SEQ ID NO: 412 - RNA, 249 nt, Artificial Sequence
  derived and/or modified CDS sequence (opt1) from MERS-CoV__ALA49390__E
augcugcccuucgugcaggagcgcaucggccucuucaucgucaacuucuucaucuucaccguggugugcgccaucacccugcuggucugcauggccuuccucacggcgacccggcugugcgugcagugcaugaccgggcugaacacccuccuggugcagcccgcccuguaccucuacaacacgggccgcagcgucuacgugaaguuccaggacuccaagccgccccugccgcccgacgaguggguguga

SEQ ID NO: 413 - RNA, 660 nt, Artificial Sequence
  derived and/or modified CDS sequence (opt1) from MERS-CoV__AFS88942__M
augagcaacaugacccagcugaccgaggcccagaucaucgccaucaucaaggacuggaacuucgcguggucccucaucuuccugcugaucacgaucgugcuccaguacggcuaccccagccgcuccaugaccgucuacguguucaagauguucgugcuguggcugcucuggccgagcuccauggcccugagcaucuucuccgccgucuaccccaucgaccuggccagccagaucaucuccgggaucguggccgcggugagcgccaugauguggaucuccuacuucguccagagcauccgccucuucaugcggaccggcuccugguggagcuucaaccccgagaccaacugccugcugaacgugcccuucgggggcacgaccgugguccggccgcucguggaggacuccaccagcgugaccgccgucgugacgaacgggcaccugaagauggccggcaugcacuucggcgcgugcgacuacgaccgccugcccaacgaggugaccgucgccaagcccaacgugcucaucgcccugaagauggugaagcggcaguccuacgggaccaacagcggcgucgccaucuaccaccgcuacaaggccgggaacuaccgguccccgcccaucaccgcggacaucgagcuggcccuccugcgcgccuga

SEQ ID NO: 414 - RNA, 660 nt, Artificial Sequence
  derived and/or modified CDS sequence (opt1) from MERS-CoV__AGH58718__M
augagcaacaugacccagcugaccgaggcccagaucaucgccgugaucaaggacuggaacuucgcguggucccucaucuuccugcugaucacgaucguccuccaguacggcuaccccagccgcuccaugaccguguacguguucaagauguucguccuguggcugcucuggccgagcuccauggcccugagcaucuucuccaccguguaccccaucgaccuggccagccagaucaucuccgggaucguggccgccgucagcgcgaugauguggaucuccuacuucgugcagagcauccgccucuucaugcggaccggcuccugguggagcuucaaccccgagacgaacugccugcugaacgugcccuucgggggcaccaccgucgugcggccgcucguggaggacuccaccagcgucacggccguggugaccaacgggcaccugaagauggccggcaugcacuucggcgccugcgacuacgaccgccugcccaacgaggucaccguggcgaagcccaacgugcucaucgcccugaagauggucaagcggcaguccuacgggaccaacagcggcguggccaucuaccaccgcuacaaggccgggaacuaccgguccccgcccaucacggccgacaucgagcuggcgcuccugcgcgccuga

SEQ ID NO: 415 - RNA, 660 nt, Artificial Sequence
  derived and/or modified CDS sequence (opt1) from MERS-CoV__AGV08396__M
augagcaacaugacccagcugaccgaggcccagaucaucgccaucaucaaggacuggaacuucgcguggucccucaucuuccugcugaucacgaucgugcuccaguacggcuaccccagccgcuccaugaccgucuacguguucaagauguucgugcuguggcugcucuggccgagcuccauggcccugagcaucuucuccgccaucuaccccaucgaccuggccagccagaucaucuccgggaucgucgccgcggugagcgccaugauguggaucuccuacuucgugcagagcauccgccucuucaugcggaccggcuccugguggagcuucaaccccgagaccaacugccugcugaacguccccuucgggggcacgaccguggugcggccgcucgucgaggacuccaccagcgugaccgccguggucacgaacgggcaccugaagauggccggcaugcacuucggcgcgugcgacuacgaccgccugcccaacgaggugaccguggccaagcccaacguccucaucgcccugaagauggugaagcggcaguccuacgggaccaacagcggcguggccaucuaccaccgcuacaaggccgggaacuaccgguccccgcccaucaccgcggacaucgagcuggcccuccugcgcgccuga

SEQ ID NO: 416 - RNA, 660 nt, Artificial Sequence
  derived and/or modified CDS sequence (opt1) from MERS-CoV__AGV08590__M
augagcaacaugacccagcugaccgaggcccagaucaucgccaucaucaaggacuggaacuucguguggucccucaucuuccugcugaucacgaucguccuccaguacggcuaccccagccgcuccaugaccguguacguguucaagauguucguccuguggcugcucuggccgagcuccauggcgcugagcaucuucuccgccguguaccccaucgaccuggccagccagaucaucuccgggaucguggccgccgucagcgcgaugauguggaucuccuacuucgugcagagcauccgccucuucaugcggaccggcuccugguggagcuucaaccccgagaccaacugccugcugaacgugcccuucgggggcacgaccgucgugcggccgcucguggaggacuccaccagcgucaccgccguggugacgaacgggcaccugaagauggccggcaugcacuucggcgccugcgacuacgaccgccugcccaacgaggucaccguggcgaagcccaacgugcucaucgcccugaagauggucaagcggcaguccuacgggaccaacagcggcguggccaucuaccaccgcuacaaggccgggaacuaccgguccccgcccaucaccgccgacaucgagcuggcgcuccugcgcgccuga

SEQ ID NO: 417 - RNA, 660 nt, Artificial Sequence
  derived and/or modified CDS sequence (opt1) from MERS-CoV__AHI48567__M
augagcaacaugacccagcuggccgaggcccagaucaucgcgaucaucaaggacuggaacuucgccuggucccucaucuuccugcugaucaccaucgugcuccaguacggcuaccccagccgcuccaugacggucuacguguucaagauguucgugcuguggcugcucuggccgagcuccauggcccugagcaucuucuccgccgucuaccccaucgaccuggccagccagaucaucuccgggaucguggcggccgugagcgccaugauguggaucuccuacuucguccagagcauccgccucuucaugcggaccggcuccugguggagcuucaaccccgagaccaacugccugcugaacgugcccuucgggggcaccacggugguccggccgcucguggaggacuccaccagcgugaccgccgucgugaccaacgggcaccugaagauggcgggcaugcacuucggcgccugcgacuacgaccgccugcccaacgaggugacggucgccaagcccaacgugcucaucgcccugaagauggugaagcggcaguccuacgggaccaacagcggcgucgccaucuaccaccgcuacaaggcggggaacuaccgguccccgcccaucaccgccgacaucgagcuggcccuccugcgcgccuga

SEQ ID NO: 418 - RNA, 660 nt, Artificial Sequence
  derived and/or modified CDS sequence (opt1) from MERS-CoV__AHI48589__M
augagcaacaugacccagcugaccgaggcccagaucaucgccgugaucaaggacuggaacuucgcguggucccucaucuuccugcugaucacgaucguccuccaguacggcuaccccagccgcuccaugaccguguacguguucaagauguucguccuguggcugcucuggccgagcuccauggcccugagcaucuucuccgccaucuaccccaucgaccuggccagccagaucaucuccgggaucguggccgcggugagcgccaugauguggaucuccuacuucguccagagcauccgccucuucaugcggaccggcuccugguggagcuucaaccccgagaccaacugccugcugaacgugcccuucgggggcacgaccgugguccggccgcucguggaggacuccaccagcgugaccgccgucgugacgaacgggcaccugaagauggccggcaugcacuucggcgcgugcgacuacgaccgccugcccaacgaggugaccgucgccaagcccaacgugcucaucgcccugaagauggugaagcggcaguccuacgggaccaacagcggcgucgccaucuaccaccgcuacaaggccgggaacuaccgguccccgcccaucaccgcggacaucgagcuggcccuccugcgcgccuga

SEQ ID NO: 419 - RNA, 660 nt, Artificial Sequence
  derived and/or modified CDS sequence (opt1) from MERS-CoV__AIL23940__M
augagcaacaugacccagcugaccgaggcccagaucaucgccaucaucaaggacuggaacuucgcguggucccucaucuuccugcugaucacgaucgugcuccaguacggcuaccccagccgcuccaugaccgucuacguguucaagauguucgugcuguggcugcucuggccgagcuccauggcccugagcaucuucuccgccaucuaccccaucgaccuggccagccagaucaucuccgggaucgucgccgcggugagcgccaugauguggaucuccuacuucgugcagagcauccgccucuucaugcggaccggcuccugguggagcuucaaccccgagaccaacugccugcugaacguccccuucgggggcacgaccguggugcggccgcucgucgaggacuccaccagcgugaccgccguggucacgaacgggcaccugaagauggccggcaugcacuucggcgcgugcgacuacgaccgccugcccaacgaggugaccguggccaagcccaacgucgugaucgcccucaagauggugaagcggcaguccuacgggaccaacagcggcgucgccaucuaccaccgcuacaaggccgggaacuaccgguccccgcccaucaccgcggacaucgagcuggcccugcuccgcgccuga

SEQ ID NO: 420 - RNA, 660 nt, Artificial Sequence
  derived and/or modified CDS sequence (opt1) from MERS-CoV__AKM76245__M
augagcaacaucacccagcugaccgaggcccagaucaucgccaucaucaaggacuggaacuucgcguggucccucaucuuccugcugaucacgaucgugcuccaguacggcuaccccagccgcuccaugaccgucuacguguucaagauguucgugcuguggcugcucuggccgagcuccauggcccugagcaucuucuccgccgucuaccccaucgaccuggccagccagaucaucuccgggaucguggccgcggugagcgccaugauguggaucuccuacuucguccagagcauccgccucuucaugcggaccggcuccugguggagcuucaaccccgagaccaacugccugcugaacgugcccuucgggggcacgaccgugguccggccgcucguggaggacuccaccagcgugaccgccgucgugacgaacgggcaccugaagauggccggcaugcacuucggcgcgugcgacuacgaccgccugcccaacgaggugaccgucgccaagcccaacgugcucaucgcccugaagauggugaagcggcaguccuacgggaccaacagcggcgucgccaucuaccaccgcuacaaggccgggaacuaccgguccccgcccaucaccgcggacaucgagcuggcccuccugcgcgccuga

SEQ ID NO: 421 - RNA, 660 nt, Artificial Sequence
  derived and/or modified CDS sequence (opt1) from MERS-CoV__ALW82726__M
augagcaacaugacccagcugaccgaggcccagaucaucgccaucaucaaggacuggcacuucgcguggucccucaucuuccugcugaucacgaucgugcuccaguacggcuaccccagccgcuccaugaccgucuacguguucaagauguucgugcuguggcugcucuggccgagcuccauggcccugagcaucuucuccgccaucuaccccaucgaccuggccagccagaucaucuccgggaucgucgccgcggugagcgccaugauguggaucuccuacuucgugcagagcauccgccucuucaugcggaccggcuccugguggagcuucaaccccgagaccaacugccugcugaacguccccaucgggggcacgaccguggugcggccgcucgucgaggacuccaccagcgugaccgccguggucacgaacgggcaccugaagauggccggcaugcacuucggcgcgugcgacuacgaccgccugcccaacgaggugaccguggccaagcccaacguccucaucgcccugaagauggugaagcggcaguccuacgggaccaacagcggcguggccaucuaccaccgcuacaaggccgggaacuaccgguccccgcccaucaccgcggacaucgagcuggcccuccugcgcgccuga

SEQ ID NO: 422 - RNA, 660 nt, Artificial Sequence
  derived and/or modified CDS sequence (opt1) from MERS-CoV__ALX27238__M
augagcaacaugacccagcugaccgaggcccagaucaucgccaucaucaaggacugguccuucgcguggagccucaucuuccugcugaucacgaucgugcuccaguacggcuaccccucccgcagcaugaccgucuacguguucaagauguucgugcuguggcugcucuggccguccagcauggcccuguccaucuucagcgccgucuaccccaucgaccuggccucccagaucaucagcgggaucguggccgcgguguccgccaugauguggaucagcuacuucguccaguccauccgccucuucaugcggaccggcagcuggugguccuucaaccccgagaccaacugccugcugaacgugcccuucgggggcacgaccgugguccggccgcucguggaggacagcaccuccgugaccgccgucgugacgaacgggcaccugaagauggccggcaugcacuucggcgcgugcgacuacgaccgccugcccaacgaggugaccgucgccaagcccaacgugcucaucgcccugaagauggugaagcggcagagcuacgggaccaacuccggcgucgccaucuaccaccgcuacaaggccgggaacuaccggagcccgcccaucaccgcggacaucgagcuggcccuccugcgcgccuga

SEQ ID NO: 423 - RNA, 660 nt, Artificial Sequence
  derived and/or modified CDS sequence (opt1) from MERS-CoV__AMQ49021__M
augagcaacaugacccagcugaccgaggcccagaucaucgccaucaucaaggacuggcacuucgcguggucccucaucuuccugcugaucacgaucgugcuccaguacggcuaccccagccgcuccaugaccgucuacguguucaagauguucgugcuguggcugcucuggcccagcuccauggcccugagcaucuucuccgccaucuaccccaucgaccuggccagccagaucaucuccgggaucgucgccgcggugagcgccaugauguggaucuccuacuucgugcagagcauccgccucuucaugcggaccggcuccugguggagcuucaaccccgagaccaacugccugcugaacguccccaucgggggcacgaccguggugcggccgcucgucgaggacuccaccagcgugaccgccguggucacgaacgggcaccugaagauggccggcaugcacuucggcgcgugcgacuacgaccgccuguccaacgaggugaccguggccaagcccaacguccucaucgcccugaagauggugaagcggcagagcuacgggaccaacuccggcguggccaucuaccaccgcuacaaggccgggaacuaccggagcccgcccaucaccgcggacaucgagcuggcccuccugcgcgccuga

SEQ ID NO: 424 - RNA, 660 nt, Artificial Sequence
  derived and/or modified CDS sequence (opt1) from MERS-CoV__AJG44108__M
augagcaacaugacccagcugaccgaggcccagaucaucgccaucaucaaggacuggaacuucgcguggucccucaucuuccugcugaucacgaucgugcuccaguacggcuaccccagccgcuccaugaccgucuacguguucaagauguucgugcuguggcugcucuggccgagcuccauggcccugagcaucuucuccgccuucuaccccaucgaccuggccagccagaucaucuccgggaucgucgccgcggugagcgccaugauguggaucuccuacuucgugcagagcauccgccucuucaugcggaccggcuccugguggagcuucaaccccgagaccaacugccugcugaacguccccuucgggggcacgaccguggugcggccgcucgucgaggacuccaccagcgugaccgccguggucacgaacgggcaccugaagauggccggcaugcacuucggcgcgugcgacuacgaccgccugcccaacgaggugaccguggccaagcccaacguccucaucgcccugaagauggugaagcggcaguccuacgggaccaacagcggcguggccaucuaccaccgcuacaaggccgggaacuaccgguccccgcccaucaccgcggacaucgagcuggcccuccugcgcgccuga

SEQ ID NO: 425 - RNA, 660 nt, Artificial Sequence
  derived and/or modified CDS sequence (opt1) from MERS-CoV__ALA49369__M
augagcaacaugacccagcugaccgaggcccagaucaucgccaucaucaaggacuggaacuucgcguggucccucaucuuccugcugaucacgaucgugcuccaguacggcuaccccagccgcuccaugaccgucuacguguucaagauguucgugcuguggcugcucuggccgagcuccauggcccugagcaucuucuccgccaucuaccccaucgaccuggccagccagaucaucuccgggaucgucgccgcggugagcgccaugauguggaucuccuacuucgugcagagcauccgccucuucaugcggaccggcuccugguggagcuucaaccccgagaccaacugccugcugaacguccccaucgggggcacgaccguggugcggccgcucgucgaggacuccaccagcgugaccgccguggucacgaacgggcaccugaagauggccggcaugcacuucggcgcgugcgacuacgaccgccugcccaacgaggugaccguggccaagcccaacguccucaucgcccugaagauggugaagcggcaguccuacgggaccaacagcggcguggccaucuaccaccgcuacaaggccgggaacuaccgguccccgcccaucaccgcggacaucgagcuggcccuccugcgcgccuga

SEQ ID NO: 426 - RNA, 660 nt, Artificial Sequence
  derived and/or modified CDS sequence (opt1) from MERS-CoV__ALA49424__M
augagcaacaugacccagcugaccgaggcccagaucaucgccaucaucaaggacuggaacuucgcguggucccucaucuuccugcugaucacgaucgugcuccaguacggcuaccccagccgcuccaugaccgucuacguguucaagauguucgugcuguggcugcucuggccgagcuccauggcccugagcaucuucuccgccaucuaccccaucgaccuggccagccagaucaucuccgggaucgucgccgcggugagcgccaugaugcggaucuccuacuucgugcagagcauccgccucuucaugcggaccggcuccugguggagcuucaaccccgagaccaacugccugcugaacguccccuucgggggcacgaccguggugcgcccgcucgucgaggacuccaccagcgugaccgccguggucacgaacgggcaccugaagauggccggcaugcacuucggcgcgugcgacuacgaccggcugcccaacgaggugaccguggccaagcccaacguccucaucgcccugaagauggugaagcgccaguccuacgggaccaacagcggcguggccaucuaccaccgguacaaggccgggaacuaccgcuccccgcccaucaccgcggacaucgagcuggcccuccugcgggccuga

SEQ ID NO: 427 - RNA, 660 nt, Artificial Sequence
  derived and/or modified CDS sequence (opt1) from MERS-CoV__ALA49908__M
augagcaacaugacccagcugaccgaggcccagaucaucgccaucaucaaggacuggaacuucgcguggucccucaucuuccugcugaucacgaucgugcuccaguacggcuaccccagccgcuccaugaccgucuacguguucaagauguucgugcuguggcugcucuggccgagcuccauggcccugagcaucuucuccgccaucuaccccaucgaccugagcucccagaucaucagcgggaucgucgccgccguguccgcgaugauguggaucagcuacuucgugcaguccauccgccucuucaugcggaccggcagcuggugguccuucaaccccgagaccaacugccugcugaacguccccuucgggggcacgaccguggugcggccgcucgucgaggacagcaccuccgugaccgccguggucacgaacgggcaccugaagauggccggcaugcacuucggcgccugcgacuacgaccgccugcccaacgaggugaccguggcgaagcccaacguccucaucgcccugaagauggugaagcggcagagcuacgggaccaacuccggcguggccaucuaccaccgcuacaaggccgggaacuaccggagcccgcccaucaccgccgacaucgagcuggcgcuccugcgcgccuga

SEQ ID NO: 428 - RNA, 660 nt, Artificial Sequence
  derived and/or modified CDS sequence (opt1) from MERS-CoV__ALA49963__M
augagcaacaugacccagcugaccgaggcccagaucaucgccaucaucaaggacuggaacuucgcguggucccucaucuuccugcugaucacgaucgugcuccaguacggcuaccccagccgcuccaugaccgucuacguguucaagauguucgugcuguggcugcucuggcccagcuccauggcccugagcaucuucuccgccaucuaccccaucgaccuggccagccagaucaucuccgggaucgucgccgcggugagcgccaugauguggaucuccuacuucgugcagagcauccgccucuucaugcggaccggcuccugguggagcuucaaccccgagaccaacugccugcugaacguccccaucgggggcacgaccguggugcggccgcucgucgaggacuccaccagcgugaccgccguggucacgaacgggcaccugaagauggccggcaugcacuucggcgcgugcgacuacgaccgccuguccaacgaggugaccguggccaagcccaacguccucaucgcccugaagauggugaagcggcagagcuacgggaccaacuccggcguggccaucuaccaccgcuacaaggccgggaacuaccggagcccgcccaucaccgcggacaucgagcuggcccuccugcgcgccuga

SEQ ID NO: 429 - RNA, 1242 nt, Artificial Sequence
  derived and/or modified CDS sequence (opt1) from MERS-CoV__AFS88943__N
auggccagccccgccgcgccgcgcgccguguccuucgccgacaacaacgacaucaccaacaccaaccugagccggggccgcgggcggaaccccaagccccgcgccgcccccaacaacacggucuccugguacaccggccucacccagcacgggaaggugccgcugaccuucccgcccggccagggggugccccugaacgcgaacagcacgcccgcccagaacgccggcuacuggcggcgccaggaccggaagaucaacaccggcaacgggaucaagcagcucgcgccccgcugguacuucuacuacaccggcaccgggcccgaggccgcccugcccuuccgggccgucaaggacggcaucgugugggugcacgaggacggggccacggacgccccguccaccuucggcacccgcaaccccaacaacgacagcgcgaucgucacccaguucgcccccggcacgaagcugcccaagaacuuccacaucgaggggaccggcgggaacucccagagcuccagccgggccuccagccucucccgcaacagcucccggagcuccagccagggcucccgcagcggcaacagcacccgggggaccuccccgggccccagcgggaucggcgccgucgggggcgaccugcuguaccucgaccugcugaaccgccuccaggcccuggaguccggcaaggugaagcagagccagcccaaggugaucacgaagaaggacgcggccgccgccaagaacaagaugcggcacaagcgcaccuccaccaagagcuucaacauggugcaggccuucgggcugcggggccccggggaccuccagggcaacuucggggaccugcagcugaacaagcucggcaccgaggacccgcgcuggccccagaucgcggagcuggcccccacggccuccgccuucaugggcaugagccaguucaagcugacccaccagaacaacgacgaccacgggaaccccguguacuuccuccgguacuccggcgccaucaagcuggacccgaagaaccccaacuacaacaaguggcuggagcuccuggagcagaacaucgacgcguacaagaccuuccccaagaaggagaagaagcagaaggcccccaaggaggagagcaccgaccagauguccgagccgcccaaggagcagcgcguccaggggagcaucacgcagcgcacccggacccgccccuccgugcagccgggccccaugaucgacgugaacaccgacuga

SEQ ID NO: 430 - RNA, 1236 nt, Artificial Sequence
  derived and/or modified CDS sequence (opt1) from MERS-CoV__AFY13314__N
auggccagccccgccgcgccgcgcgccguguccuucgccgacaacaacgacaucaccaacaccaaccugagccggggccgcgggcggaaccccaagccccgcgccgcccccaacaacacggucuccugguacaccggccucacccagcacgggaaggugccgcugaccuucccgcccggccagggggugccccugaacgcgaacagcacgcccgcccagaacgccggcuacuggcggcgccaggaccggaagaucaacaccggcaacgggaucaagcagcucgcgccccgcugguacuucuacuacaccggcaccgggcccgaggccgcccugcccuuccgggccgucaaggacggcaucgugugggugcacgaggacggggccacggacgccccguccaccuucggcacccgcaaccccaacaacgacagcgcgaucgucacccaguucgcccccggcacgaagcugcccaagaacuuccacaucgaggggaccggcgggaacucccagagcuccagccgggccuccagcgugucccgcaacagcucccggagcuccagccagggcucccgcagcggcaacagcacccgggggaccuccccgggccccagcgggaucggcgccgucgggggcgaccuccuguaccuggaccuccugaaccgccugcaggcccucgaguccggcaaggugaagcagagccagcccaaggugaucacgaagaaggacgcggccgccgccaagaacaagaugcggcacaagcgcaccuccaccaagagcuucaacauggugcaggccuucgggcugcggggccccggggaccugcagggcaacuucggggaccuccagcugaacaagcugggcaccgaggacccgcgcuggccccagaucgcggagcucgcccccacggccuccgccuucaugggcaugagccaguucaagcugacccaccagaacaacgacgaccacgggaaccccgucuacuuccugcgguacuccggcgccaucaagcucgacccgaagaaccccaacuacaacaaguggcuggagcugcucgagcagaacaucgacgcguacaagaccuuccccaagaaggagaagaagcagaaggcccccaaggaggagagcaccgaccagauguccgagccgcccaaggagcaccgcgugcaggggacgcagcgcacccggacccgccccagcgugcagccgggccccaugaucgacgucaacaccgacuga

SEQ ID NO: 431 - RNA, 1242 nt, Artificial Sequence
  derived and/or modified CDS sequence (opt1) from MERS-CoV__AGH58724__N
auggccagccccgccgcgccgcgcgccguguccuucgccuacaacaacgacaucaccaacaccaaccugagccggggccgcgggcggaaccccaagccccgcgccgcccccaacaacacggucuccugguacaccggccucacccagcacgggaaggugccgcugaccuucccgcccggccagggggugccccugaacgcgaacagcacgcccgcccagaacgccggcuacuggcggcgccaggaccggaagaucaacaccggcaacgggaucaagcagcucgcgccccgcugguacuucuacuacaccggcaccgggcccgaggccgcccugcccuuccgggccgucaaggacggcaucgugugggugcacgaggacggggccacggacgccccguccaccuucggcacccgcaaccccaacaacgacagcgcgaucgucacccaguucgcccccggcacgaagcugcccaagaacuuccacaucgaggggaccggcgggaacucccagagcuccagccgggccuccagcgugucccgcaacagcucccggagcuccagccagggcucccgcagcggcaacagcacccgggggaccuccccgggccccagcgggaucggcgccgucgggggcgaccuccuguaccuggaccuccugaaccgccugcaggcccucgaguccggcaaggugaagcagagccagcccaaggugaucacgaagaaggacgcggccgccgccaagaacaagaugcggcacaagcgcaccuccaccaagagcuucaacauggugcaggccuucgggcugcggggccccggggaccugcagggcaacuucggggaccuccagcugaacaagcugggcaccgaggacccgcgcuggccccagaucgcggagcucgcccccacggccuccgccuucaugggcaugagccaguucaagcugacccaccagaacaacgacgaccacgggaaccccgucuacuuccugcgguacuccggcgccaucaagcucgacccgaagaaccccaacuacaacaaguggcuggagcugcucgagcagaacaucgacgcguacaagaccuuccccaagaaggagaagaagcagaaggcccccaaggaggagagcaccgaccagauguccgagccgcccaaggagcagcgcgugcaggggagcaucacgcagcgcacccggacccgccccuccgugcagccgggccccaugaucgacgucaacaccgacuga

SEQ ID NO: 432 - RNA, 1242 nt, Artificial Sequence
  derived and/or modified CDS sequence (opt1) from MERS-CoV__AGV08397__N
auggccagccccgccgcgccgcgcgccguguccuucgccgacaacaacgacaucaccaacaccaaccugagccggggccgcgggcggaaccccaagccccgcgccgcccccaacaacacggucuccugguacaccggccucacccagcacgggaaggugccgcugaccuucccgcccggccagggggugccccugaacgcgaacagcacgcccgcccagaacgccggcuacuggcggcgccaggaccggaagaucaacaccggcaacgggaucaagcagcucgcgccccgcugguacuucuacuacaccggcaccgggcccgaggccgcccugcccuuccgggccgucaaggacggcaucgugugggugcacgaggacggggccacggacgccccguccaccuucggcacccgcaaccccaacaacgacagcgcgaucgucacccaguucgcccccggcacgaagcugcccaagaacuuccacaucgaggggaccggcgggaacucccagagcuccagccgggccuccagcgugucccgcaacagcucccggagcuccagccagggcucccgcagcggcaacagcacccgggggaccuccccgggccccagcgggaucggcgccgucgggggcgaccuccuguaccuggaccuccugaaccgccugcaggcccucgaguccggcaaggugaagcagagccagcccaaggugaucacgaagaaggacgcggccgccgccaagaacaagaugcggcacaagcgcaccuccaccaagagcuucaacauggugcaggccuucgggcugcggggccccggggaccugcagggcaacuucggggaccuccagcugaacaagcugggcaccgaggacccgcgcuggccccagaucgcggagcucgcccccacggccuccgccuucaugggcaugagccaguucaagcugacccaccagaacaacgacgaccacgggaaccccgucuacuuccugcgguacuccggcgccaucaagcucgacccgaagaaccccaacuacaacaaguggcuggagcugcucgagcagaacaucgacgcguacaagaccuuccccaagaaggagaagaagcagaaggcccccaaggaggagcugaccgaccagaugagcgagccgcccaaggagcagcgcgugcagggguccaucacgcagcgcacccggacccgccccagcgugcagccgggccccaugaucgacgucaacaccgacuga

SEQ ID NO: 433 - RNA, 1242 nt, Artificial Sequence
  derived and/or modified CDS sequence (opt1) from MERS-CoV__AGV08415__N
auggccagccccgccgcgccgcgcgccguguccuucgccgacaacaacgacaucaccaacaccaaccugagccggggccgcgggcggaaccccaagccccgcgccgcccccaacaacacggucuccugguacaccggccucacccagcacgggaaggugccgcugaccuucccgcccggccagggggugccccugaacgcgaacagcacgcccgcccagaacgccggcuacuggcggcgccaggaccggaagaucaacaccggcaacgggaucaagcagcucgcgccccgcugguacuucuacuacaccggcaccgggcccgaggccgcccugcccuuccgggccgucaaggacggcaucgugugggugcacgaggacggggccacggacgccccguccaccuucggcacccgcaaccccaacaacgacagcgcgaucgucacccaguucgcccccggcacgaagcugcccaagaacuuccacaucgaggggaccggcgggaacucccagagcuccagccgggccuccagcgugucccgcaacagcucccggagcuccagccagggcucccgcagcggcaacagcacccgggggaccuccccgggccccagcgggaucggcgccgucgggggcgaccuccuguaccuggaccuccugaaccgccugcaggcccucgaguccggcaaggugaagcagagccagcccaaggugaucacgaagaaggacgcggccgccgccaagaacaagaugcggcacaagcgcaccuccaccaagagcuucaacauggugcaggccuucgggcugcggggccccggggaccugcagggcaacuucggggaccuccagcugaacaagcugggcaccgaggacccgcgcuggccccagaucgcggagcucgcccccacggccuccgccuucaugggcaugagccaguucaagcugacccaccagaacaacgacgaccacgggaaccccgucuacuuccugcgguacuccggcgccaucaagcucgacccgaagaaccccaacuacaacaaguggcuggagcugcucgagcagaacaucgacgcguacaagaccuuccccaagaaggagaagaagcagaaggcccccaaggaggagagcaccgaccagauguccgagccgcccaaggagcagcgcgugcaggggagcaucacgcagcgcacccggacccgccccuccgugcagccgggccccaugaucgacgucaacaccgacuga

SEQ ID NO: 434 - RNA, 1242 nt, Artificial Sequence
  derived and/or modified CDS sequence (opt1) from MERS-CoV__AGV08487__N
auggccagccccgccgcgccgcgcgccguguccuucgccgacaacaacgacaucaccaacaccaaccugagccggggccgcgggcggaaccccaagccccgcgccgcccccaacaacacggucuccugguacaccggccucacccagcacgggaaggugccgcugaccuucccgcccggccagggggugccccugaacgcgaacagcacgcccgcccagaacgccggcuacuggcggcgccaggaccggaagaucaacaccggcaacgggaucaagcagcucgcgccccgcugguacuucuacuacaccggcaccgggcccgaggccgcccugcccuuccgggccgucaaggacggcaucgugugggugcacgagcacggggccacggacgccccguccaccuucggcacccgcaaccccaacaacgacagcgcgaucgucacccaguucgcccccggcacgaagcugcccaagaacuuccacaucgaggggaccggcgggaacucccagagcuccagccgggccuccagcgugucccgcaacagcucccggagcuccagccagggcucccgcagcggcaacagcacccgggggaccuccccgggccccagcgggaucggcgccgucgggggcgaccuccuguaccuggaccuccugaaccgccugcaggcccucgaguccggcaaggugaagcagagccagcccaaggugaucacgaagaaggacgcggccgccgccaagaacaagaugcggcacaagcgcaccuccaccaagagcuucaacauggugcaggccuucgggcugcggggccccggggaccugcagggcaacuucggggaccuccagcugaacaagcugggcaccgaggacccgcgcuggccccagaucgcggagcucgcccccacggccuccgccuucaugggcaugagccaguucaagcugacccaccagaacaacgacgaccacgggaaccccgucuacuuccugcgguacuccggcgccaucaagcucgacccgaagaaccccaacuacaacaaguggcuggagcugcucgagcagaacaucgacgcguacaagaccuuccccaagaaggagaagaagcagaaggcccccaaggaggagagcaccgaccagauguccgagccgcccaaggagcagcgcgugcaggggagcaucacgcagcgcacccggacccgccccuccgugcagccgggccccaugaucgacgucaacaccgacuga

SEQ ID NO: 435 - RNA, 1242 nt, Artificial Sequence
  derived and/or modified CDS sequence (opt1) from MERS-CoV__AHC74095__N
auggccagccccgccgcgccgcgcgccguguccuucgccgacaacaacgacaucaccaacaccaaccugagccggggccgcgggcggaaccccaagccccgcgccgcccccaacaacacggucuccugguacaccggccucacccagcacgggaaggugccgcugaccuucccgcccggccagggggugccccugaacgcgaacagcacgcccgcccagaacgccggcuacuggcggcgccaggaccggaagaucaacaccggcaacgggaucaagcagcucgcgccccgcugguacuucuacuacaccggcaccgggcccgaggccgcccugcccuuccgggccgucaaggacggcaucgugugggugcacgaggacggggccacggacgccccguccaccuucggcacccgcaaccccaacaacgaccuggcgaucgucacccaguucgcccccggcacgaagcuccccaagaacuuccacaucgaggggaccggcgggaacagccaguccagcucccgggccagcuccgugagccgcaacuccagccgguccagcucccagggcagccgcuccggcaacagcacccgggggaccagcccgggccccuccgggaucggcgccgucgggggcgaccugcuguaccucgaccugcugaaccgccuccaggcccuggagagcggcaaggugaagcagucccagcccaaggugaucacgaagaaggacgcggccgccgccaagaacaagaugcggcacaagcgcaccagcaccaaguccuucaacauggugcaggccuucgggcugcggggccccggggaccuccagggcaacuucggggaccugcagcugaacaagcucggcaccgaggacccgcgcuggccccagaucgcggagcuggcccccacggccagcgccuucaugggcaugucccaguucaagcugacccaccagaacaacgacgaccacgggaaccccgucuacuuccuccgguacagcggcgccaucaagcuggacccgaagaaccccaacuacaacaaguggcuggagcuccuggagcagaacaucgacgcguacaagaccuuccccaagaaggagaagaagcagaaggcccccaaggaggaguccaccgaccagaugagcgagccgcccaaggagcagcgcgugcagggguccaucacgcagcgcacccggacccgccccagcgugcagccgggccccaugaucgacgucaacaccgacuga

SEQ ID NO: 436 - RNA, 1242 nt, Artificial Sequence
  derived and/or modified CDS sequence (opt1) from MERS-CoV__AHI48535__N
auggccagccccgccgcgccgcgcgccguguccuucgccgacaacaacgacaucaccaacaccaaccugagccggggccgcgggcggaaccccaagccccgcgccgcccccaacaacacggucuccugguacaccggccucacccagcacgggaaggugccgcugaccuucagccccggccagggggugccccugaacgcgaacuccacgcccgcccagaacgccggcuacuggcggcgccaggaccggaagaucaacaccggcaacgggaucaagcagcucgccccgcgcugguacuucuacuacaccggcaccgggcccgaggcggcccugcccuuccgggccgucaaggacggcaucgugugggugcacgaggacggggccacggacgcccccagcaccuucggcacccgcaacccgaacaacgacuccgcgaucgucacccaguucgcccccggcacgaagcugcccaagaacuuccacaucgaggggaccggcgggaacagccaguccagcucccgggccagcuccgugagccgcaacuccagccgguccagcucccagggcagccgcagcggcaacuccacccgggggaccagccccggcccguccgggaucggcgccgucgggggcgaccuccuguaccuggaccuccugaaccgccugcaggcccucgagagcggcaaggugaagcagucccagcccaaggugaucacgaagaaggacgcggccgccgccaagaacaagaugcggcacaagcgcaccagcaccaaguccuucaacauggugcaggccuucgggcugcggggccccggggaccugcagggcaacuucggggaccuccagcugaacaagcugggcaccgaggacccccgcuggccgcagaucgcggagcucgcccccacggccagcgccuucaugggcaugucccaguucaagcugacccaccagaacaacgacgaccacgggaaccccgucuacuuccugcgguacagcggcgccaucaagcucgaccccaagaacccgaacuacaacaaguggcuggagcugcucgagcagaacaucgacgcguacaagaccuuccccaagaaggagaagaagcagaaggcccccaaggaggaguccaccgaccaggugagcgagcccccgaaggagcagcgcgugcaggggaucaucacgcagcgcacccggacccgccccuccguccagcccggcccgaugaucgacgugaacaccgacuga

SEQ ID NO: 437 - RNA, 1242 nt, Artificial Sequence
  derived and/or modified CDS sequence (opt1) from MERS-CoV__AIL23941__N
auggccagccuggccgcgccccgcgccguguccuucgccgacaacaacgacaucaccaacaccaaccucagccggggccgcgggcggaacccgaagccccgcgccgcccccaacaacacggucuccugguacaccggccugacccagcacgggaaggugccccugaccuucccgcccggccagggggugccccucaacgcgaacagcacgcccgcccagaacgccggcuacuggcggcgccaggaccggaagaucaacaccggcaacgggaucaagcagcuggccccgcgcugguacuucuacuacaccggcaccgggcccgaggcggcccugcccuuccgggccgucaaggacggcaucgugugggugcacgagcacggggccacggacgcccccuccaccuucggcacccgcaacccgaacaacgacagcgcgaucgucacccaguucgcccccggcacgaagcuccccaagaacuuccacaucgaggggaccggcgggaacucccagagcuccagccgggccuccagcgugucccgcaacagcucccggagcuccagccagggcucccgcagcggcaacagcacccgggggaccucccccggcccgagcgggaucggcgccgucgggggcgaccugcuguaccucgaccugcugaaccgccuccaggcccuggaguccggcaaggugaagcagagccagcccaaggugaucacgaagaaggacgcggccgccgccaagaacaagaugcggcacaagcgcaccuccaccaagagcuucaacauggugcaggccuucgggcugcggggccccggggaccuccagggcaacuucggggaccugcagcugaacaagcucggcaccgaggacccccgcuggccgcagaucgcggagcuggcccccacggccuccgccuucaugggcaugagccaguucaagcugacccaccagaacaacgacgaccacgggaaccccgucuacuuccuccgguacuccggcgccaucaagcuggaccccaagaacccgaacuacaacaaguggcuggagcuccuggagcagaacaucgacgcguacaagaccuuccccaagaaggagaagaagcagaaggcccccaaggaggagagcaccgaccagauguccgagcccccgaaggagcagcgcgugcaggggagcaucacgcagcgcacccggacccgccccuccgugcagcccggcccgaugaucgacgucaacaccgacuga

SEQ ID NO: 438 - RNA, 1242 nt, Artificial Sequence
  derived and/or modified CDS sequence (opt1) from MERS-CoV__AIL23996__N
auggccagccccgccgcgccgcgcgccguguccuucgccgacaacaacgacaucaccaacaccaaccugagccggggccgcgggcggaaccccaagccccgcgccgcccccaacaacacggucuccugguacaccggccucacccagcacgggaaggugccgcugaccuucccgcccggccagggggugccccugaacgcgaacagcacgcccgcccagaacgccggcuacuggcggcgccaggaccggaagaucaacaccggcaacgggaucaagcagcucgcgccccgcugguacuucuacuacaccggcaccgggcccgaggccgcccugcccuuccgggccgucaaggacggcaucgugugggugcacgaggacggggccacggacgccccguccaccuucggcacccgcaaccccaacaacgaccuggcgaucgucacccaguucgcccccggcacgaagcuccccaagaacuuccacaucgaggggaccggcgggaacagccaguccagcucccgggccagcuccgugagccgcaacuccagccgguccagcucccagggcagccgcuccggcaacagcacccgggggaccagcccgggccccuccgggaucggcgccgucgggggcgaccugcuguaccucgaccugcugaaccgccuccaggcccuggagagcggcaaggugaagcagucccagcccaaggugaucacgaagaaggacgcggccgccgccaagaacaagaugcggcacaagcgcaccagcaccaaguccuucaacauggugcaggccuucgggcugcggggccccggggaccuccagggcaacuucggggaccugcagcugaacaagcucggcaccgaggacccgcgcuggccccagaucgcggagcuggcccccacggccagcgccuucaugggcaugucccaguucaagcugacccaccagaacaacgacgaccacgggaaccccgucuacuuccuccgguacagcggcgccaucaagcuggacccgaagaaccccaacuacaacaaguggcuggagcuccuggagcagaacaucgacgcguacaagaccuuccccaagaaggagaagaagcagaaggcccccaaggaggaguccaccgaccagaugagcgagccgcccaaggagcagcgcgugcagggguccaucacgcagcacacccgcacccggcccagcgugcagccgggccccaugaucgacgucaacaccgacuga

SEQ ID NO: 439 - RNA, 1242 nt, Artificial Sequence
  derived and/or modified CDS sequence (opt1) from MERS-CoV__AIY60565__N
auggccgcccccgcggccccgcgcgccgugagcuucgccgacaacaacgacaucaccaacaccaaccugucccggggccgcgggcggaaccccaagccccgcgccgcgcccaacaacacggucagcugguacaccggccucacccagcacgggaaggugccgcugaccuucccgcccggccagggggugccccugaacgccaacuccacgcccgcccagaacgccggcuacuggcggcgccaggaccggaagaucaacaccggcaacgggaucaagcagcucgcgccccgcugguacuucuacuacaccggcaccgggcccgaggccgcccugcccuuccgggccgucaaggacggcaucgugugggugcacgaggacggggccacggacgcgccgagcaccuucggcacccgcaaccccaacaacgacuccgccaucgucacccaguucgcccccggcacgaagcugcccaagaacuuccacaucgaggggaccggcgggaacagccaguccagcucccgggccagcuccgugagccgcaacuccagccgguccagcucccagggcagccgcuccggcaacagcacccgggggaccagcccggugcccuccggcaucggggccgucggcggggaccuccuguaccuggaccuccugaaccgccugcaggcgcucgagagcggcaaggugaagcagucccagcccaaggugaucacgaagaaggacgccgccgccgccaagaacaagaugcggcacaagcgcaccagcaccaaguccuucaacaugguccaggcguucggccugcgggggcccggcgaccugcaggggaacuucggcgaccuccagcugaacaagcuggggaccgaggacccgcgcuggccccagaucgccgagcucgcccccacggccagcgccuucaugggcaugucccaguucaagcugacccaccagaacaacgacgaccacggcaaccccguguacuuccugcgguacagcggggcgaucaagcucgacccgaagaaccccaacuacaacaaguggcuggagcugcucgagcagaacaucgacgccuacaagaccuuccccaagaaggagaagaagcagaaggcccccaaggaggaguccaccgaccagaugagcgagccgcccaaggagcagcgcgugcagggcuccaucacgcagcgcacccggacccgccccagcguccagccggggcccaugaucgacgugaacaccgacuga

SEQ ID NO: 440 - RNA, 1242 nt, Artificial Sequence
  derived and/or modified CDS sequence (opt1) from MERS-CoV__AIZ74424__N
auggccgcccccgcggccccgcgcgccgugagcuucgccgacaacaacgacaucaccaacaccaaccugucccggggccgcgggcggaaccccaagccccgcgccgcgcccaacaacacggucagcugguacaccggccucacccagcacgggaaggugccgcugaccuucccgcccggccagggggugccccugaacgccaacuccacgcccgcccagaacgccggcuacuggcggcgccaggaccggaagaucaacaccggcaacgggaucaagcagcucgcgccccgcugguacuucuacuacaccggcaccgggcccgaggccgcccugcccuuccgggccgucaaggacggcaucgugugggugcacgaggacggggccacggacgcgccgagcaccuucggcacccgcaaccccaacaacgacuccgccaucgucacccaguucgcccccggcacgaagcugcccaagaacuuccacaucgaggggaccggcgggaacagccaguccagcucccgggccagcuccgugagccgcaacuccagccgguccagcucccagggcagccgcuccggcaacagcacccgggggaccagcccgggccccuccgggaucggcgccgucgggggcgaccuccuguaccuggaccuccugaaccgccugcaggcgcucgagagcggcaaggugaagcagucccagcccaaggugaucacgaagaaggacgccgccgccgccaagaacaagaugcggcacaagcgcaccagcaccaaguccuucaacauggugcaggcguucgggcugcggggccccggggaccugcagggcaacuucggggaccuccagcugaacaagcugggcaccgaggacccgcgcuggccccagaucgccgagcucgcccccacggccagcgccuucaugggcaugucccaguucaagcugacccaccagaacaacgacgaccacgggaaccccgucuacuuccugcgguacagcggcgcgaucaagcucgacccgaagaaccccaacuacaacaaguggcuggagcugcucgagcagaacaucgacgccuacaagaccuuccccaagaaggagaagaagcagaaggcccccaaggaggaguccaccgaccagaugagcgagccgcccaaggagcagcgcgugcagggguccaucacgcagcgcacccggacccgccccagcgugcagccgggccccaugaucgacgucaacaccgacuga

SEQ ID NO: 441 - RNA, 1242 nt, Artificial Sequence; identical to SEQ ID NO: 440
  derived and/or modified CDS sequence (opt1) from MERS-CoV__AIZ74430__N

SEQ ID NO: 442 - RNA, 1242 nt, Artificial Sequence
  derived and/or modified CDS sequence (opt1) from MERS-CoV__AKI29291__N
auggccagccccgccgcgccgcgcgccguguccuucgccgacaacaacgacaucaccaacaccaaccugagccggggccgcgggcggaaccccaagccccgcgccgcccccaacaacacggucuccugguacaccggccucacccagcacgggaaggugccgcugaccuucccgcccggccagggggugccccugaacgcgaacagcacgcccgcccagaacgccggcuacuggcggcgccaggaccggaagaucaacaccggcaacgggaucaagcagcucgcgccccgcugguacuucuacuacaccggcaccgggcccgaggccgcccugcccuuccgggccgucaaggacggcaucgugugggugcacgaggacggggccacggacgccccguccaccuucggcacccgcaaccccaacaacgacagcgcgaucgucacccaguucgcccccggcacgaagcugcccaagaacuuccacaucgaggggaccggcgggaacucccagagcuccagccgggccuccagcgugucccgcaacagcucccggagcuccagccagggcucccgcagcggcaacagcacccgggggaccuccccgggccccagcgggaucggcgccgucgggggcgaccuccuguaccuggaccuccugaaccgccugcaggcccucgaguccggcaaggugaagcagagccagcccaaggugaucacgaagaaggacgcggccgccgccaagaacaagaugcggcacaagcgcaccuccaccaagagcuucaacauggugcaggccuucgggcugcggggccccggggaccugcagggcaacuucggggaccuccagcugaacaagcugggcaccgaggacccgcgcuggccccagaucgcggagcucgcccccacggccuccgccuucaugggcaugagccaguucaagcugacccaccagaacaacgacgaccacgggaaccccgucuacuuccugcgguacuccggcgccaucaagcucgacccgaagaaccccaacuacaacaaguggcuggagcugcucgagcagaacaucgacgcguacaagaccuuccccaagaaggagaagaagcagaaggcccccaaggaggagagcaccgaccagauguccgagccgcccaaggagcagcgcgugcaggggagcaucacgcagcgcauccggacccgccccuccgugcagccgggccccaugaucgacgucaacaccgacuga

SEQ ID NO: 443 - RNA, 1242 nt, Artificial Sequence
  derived and/or modified CDS sequence (opt1) from MERS-CoV__AKK52599__N
auggccagccccgccgcgccgugcgccguguccuucgccgacaacaacgacaucaccaacaccaaccugagccgcggccgggggcgcaaccccaagccccgggccgcccccaacaacacggucuccugguacaccggccucacccagcacgggaaggugccgcugaccuucccgcccggccagggggugccccugaacgcgaacagcacgcccgcccagaacgccggcuacuggcgccggcaggaccgcaagaucaacaccggcaacgggaucaagcagcucgcgccccggugguacuucuacuacaccggcaccgggcccgaggccgcccugcccuuccgcgccgucaaggacggcaucgugugggugcacgaggacggggccacggacgccccguccaccuucggcacccggaaccccaacaacgacagcgcgaucgucacccaguucgcccccggcacgaagcugcccaagaacuuccacaucgaggggaccggcgggaacucccagagcuccagccgcgccuccagcgugucccggaacagcucccgcagcuccagccagggcucccggagcggcaacagcacccgcgggaccuccccgggccccagcgggaucggcgccgucgggggcgaccuccuguaccuggaccuccugaaccggcugcaggcccucgaguccggcaaggugaagcagagccagcccaaggugaucacgaagaaggacgcggccgccgccaagaacaagaugcgccacaagcggaccuccaccaagagcuucaacauggugcaggccuucgggcugcgcggccccggggaccugcagggcaacuucggggaccuccagcugaacaagcugggcaccgaggacccgcgguggccccagaucgcggagcucgcccccacggccuccgccuucaugggcaugagccaguucaagcugacccaccagaacaacgacgaccacgggaaccccgucuacuuccugcgcuacuccggcgccaucaagcucgacccgaagaaccccaacuacaacaaguggcuggagcugcucgagcagaacaucgacgcguacaagaccuuccccaagaaggagaagaagcagaaggcccccaaggaggagagcaccgaccagauguccgagccgcccaaggagcagcgggugcaggggagcaucacgcagcgcacccgcacccggcccuccgugcagccgggccccaugaucgacgucaacaccgacuga

SEQ ID NO: 444 - RNA, 1242 nt, Artificial Sequence
  derived and/or modified CDS sequence (opt1) from MERS-CoV__AKN24774__N
auggccagccccgccgcgccgcgcgccguguccuucgccgacaacaacgacaucaccaacaccaaccugagccggggccgcgggcggaaccccaagccccgcgccgcccccaacaacacggucuccugguacaccggccucacccagcacgggaaggugccgcugaccuucccgcccggccagggggugccccugaacgcgaacagcacgcccgcccagaacgccggcuacuggcggcgccaggaccggaagaucaacaccggcaacgggaucaagcagcucgcgccccgcugguacuucuacuacaccggcaccgggcccgaggccgcccugcccuuccgggccgucaaggacggcaucgugugggugcacgaggacggggccacggacgccccguccaccuucggcacccgcaaccccaacaacgaccuggcgaucgucacccaguucgcccccggcacgaagcuccccaagaacuuccacaucgaggggaccggcgggaacagccaguccagcucccgggccagcuccgugagccgcaacuccagccgguccagcucccagggcagccgcuccggcaacagcacccgggggaccagcccgggccccuccgggaucggcgccgucgggggcgaccugcuguaccucgaccugcugaaccgccuccaggcccuggagagcggcaaggugaagcagucccagcccaaggugaucacgaagaaggacgcggccgccgccaagaacaagaugcggcacaagcgcaccagcaccaaguccuucaacauggugcaggccuucgggcugcggggccccggggaccuccagggcaacuucggggaccugcagcugaacaagcucggcaccgaggacccgcgcuggccccagaucgcggagcugguccccacggccagcgccuucaugggcaugucccaguucaagcugacccaccagaacaacgacgaccacgggaaccccguguacuuccuccgguacagcggcgccaucaagcuggacccgaagaaccccaacuacaacaaguggcuggagcuccuggagcagaacaucgacgccuacaagaccuuccccaagaaggagaagaagcagaaggcgcccaaggaggaguccaccgaccagaugagcgagccgcccaaggagcagcgcgugcagggguccaucacgcagcacacccgcacccggcccagcguccagccgggccccaugaucgacgugaacaccgacuga

SEQ ID NO: 445 - RNA, 1242 nt, Artificial Sequence
  derived and/or modified CDS sequence (opt1) from MERS-CoV__ALW82676__N
auggccagccccgccgcgccgcgcgccguguccuucgccgacaacaacgacaccaccaacacgaaccugagccggggccgcgggcggaaccccaagccccgcgccgcccccaacaacaccgucuccugguacaccggccucacccagcacgggaaggugccgcugacguucccgcccggccagggggugccccugaacgcgaacagcacccccgcccagaacgccggcuacuggcggcgccaggaccggaagaucaacaccggcaacgggaucaagcagcucgcgccccgcugguacuucuacuacaccggcacggggcccgaggccgcccugcccuuccgggccgucaaggacggcaucgugugggugcacgaggacggggccaccgacgccccguccaccuucggcacccgcaaccccaacaacgacagcgcgaucgucacgcaguucgcccccggcaccaagcugcccaagaacuuccacaucgaggggaccggcgggaacucccagagcuccagccgggccuccagcgugucccgcaacagcucccggagcuccagccagggcucccgcagcggcaacagcacccgggggacguccccgggccccagcgggaucggcgccgucgggggcgaccuccuguaccuggaccuccugaaccgccugcaggcccucgaguccggcaaggugaagcagagccagcccaaggugaucaccaagaaggacgcggccgccgccaagaacaagaugcggcacaagcgcaccuccaccaagagcuucaacauggugcaggccuucgggcugcggggccccggggaccugcagggcaacuucggggaccuccagcugaacaagcugggcacggaggacccgcgcuggccccagaucgcggagcucgcccccaccgccuccgccuucaugggcaugagccaguucaagcugacccaccagaacaacgacgaccacgggaaccccgucuacuuccugcgguacuccggcgccaucaagcucgacccgaagaaccccaacuacaacaaguggcuggagcugcucgagcagaacaucgacgcguacaagaccuuccccaagaaggagaagaagcagaaggcccccaaggaggagagcacggaccagauguccgagccgcccaaggagcagcgcgugcaggggagcaucacccagcgcacccggacccgccccuccgugcagccgggccccaugaucgacgucaacacggacuga

SEQ ID NO: 446 - RNA, 1242 nt, Artificial Sequence
  derived and/or modified CDS sequence (opt1) from MERS-CoV__AMQ49033__N
auggccagccccgccgcgccgcgcgccguguucuucgccgacaacaacgacaucaccaacaccaaccugucccggggccgcgggcggaaccccaagccccgcgccgcccccaacaacacggucagcugguacaccggccucacccagcacgggaaggugccgcugaccuucccgcccggccagggggugccccugaacgcgaacuccacgcccgcccagaacgccggcuacuggcggcgccaggaccggaagaucaacaccggcaacgggaucaagcagcucgcgccccgcugguacuucuacuacaccggcaccgggcccgaggccgcccugcccuuccgggccgucaaggacggcaucgugugggugcacgaggacggggccacggacgccccgagcaccuucggcacccgcaaccccaacaacgacuccgcgaucgucacccaguucgcccccggcacgaagcugcccaagaacuuccacaucgaggggaccggcgggaacagccaguccagcucccgggccagcuccgugagccgcaacuccagccgguccagcucccagggcagccgcuccggcaacagcacccgggggaccagcccgggccccuccgggaucggcgccgucgggggcgaccuccuguaccuggaccuccugaaccgccugcaggcccucgagagcggcaaggugaagcagucccagcccaaggugaucacgaagaaggacgcggccgccgccaagaacaagaugcggcacaagcgcaccagcaccaaguccuucaacauggugcaggccuucgggcugcggggccccggggaccugcagggcaacuucggggaccuccaguucaacaagcugggcaccgaggacccgcgcuggccccagaucgcggagcuggcccccacggccagcgccuucaugggcaugucccaguucaagcucacccaccagaacaacgacgaccacgggaaccccgucuacuuccugcgguacagcggcgccaucaagcuggacccgaagaaccccaacuacaacaaguggcucgagcugcuggagcagaacaucgacgcguacaagaccuuccccaagaaggagaagaagcagaaggcccccaaggaggaguccaccgaccagaugagcgagccgcccaaggagcagcgcgugcagggguccaucacgcagcgcacccggacccgccccagcgugcagccgggccccaugaucgacgucaacaccgacuga

SEQ ID NO: 447 - RNA, 1242 nt, Artificial Sequence
  derived and/or modified CDS sequence (opt1) from MERS-CoV__AHL18098__N
auggccagcuccgccgcgccccgcgccgugagcuucgccgacaacaacgacaucaccaacaccaaccugucccggggccgcgggcggaacccgaagccccgcgccgcccccaacaacacggucagcugguacaccggccucacccagcacgggaaggugccccugaccuucccgcccggccagggggugccccugaacgcgaacuccacgcccgcccagaacgccggcuacuggcggcgccaggaccggaagaucaacaccggcaacgggaucaagcagcucgccccgcgcugguacuucuacuacaccggcaccgggcccgaggcggcccugcccuuccgggccgucaaggacggcaucgugugggugcacgaggacggggccacggacgcccccagcaccuucggcacccgcaacccgaacaacgacuccgcgaucgucacccaguucgcccccggcacgaagcugcccaagaacuuccacaucgaggggaccggcgggaacagccaguccagcucccgggccagcuccgugagccgcaacuccagccgguccagcucccagggcagccgcagcggcaacuccacccgggggaccagccccggcccguccgggaucggcgccgucgggggcgaccuccuguaccuggaccuccugaaccgccugcaggcccucgagagcggcaaggugaagcagucccagcccaaggugaucacgaagaaggacgcggccgccgccaagaacaagaugcggcacaagcgcaccagcaccaaguccuucaacauggugcaggccuucgggcugcggggccccggggaccugcagggcaacuucggggaccuccagcugaacaagcugggcaccgaggacccccgcuggccgcagaucgcggagcucgcccccacggccagcgccuucaugggcaugucccaguucaagcugacccaccagaacaacgacgaccacgggaaccccgucuacuuccugcgguacagcggcgccaucaagcucgaccccaagaacccgaacuacaacaaguggcuggagcugcucgagcagaacaucgacgcguacaagaccuuccccaagaaggagaacaagcagaaggcccccaaggaggaguccaccgaccagaugagcgagcccccgaaggagcagcgcgugcagggguccaucacgcagcgcacccggacccgccccagcgugcagcccggcccgaugaucgacgucaacaccgacuga

SEQ ID NO: 448 - RNA, 1242 nt, Artificial Sequence
  derived and/or modified CDS sequence (opt1) from MERS-CoV__AHX00738__N
auggccgcccccgcggccccgcgcgccgugagcuucgccgacaacaacgacaucaccaacaccaacaugucccggggccgcgggcggaaccccaagccccgcgccgcgcccaacaacacggucagcugguacaccggccugacccagcacgggaaggugccgcucaccuucccgcccggccagggggugccccugaacgccaacuccacgcccgcccagaacgccggcuacuggcggcgccaggaccggaagaucaacaccggcaacgggaucaagcagcuggcgccccgcugguacuucuacuacaccggcaccgggcccgaggccgcccuccccuuccgggccgucaaggacggcaucgugugggugcacgaggacggggccacggacgcgccgagcaccuucggcacccgcaaccccaacaacgacuccgccaucgucacccaguucgcccccggcacgaagcugcccaagaacuuccacaucgaggggaccggcgggaacagccaguccagcucccgggccagcuccgugagccgcaacuccagccgguccagcucccagggcagccgcuccggcaacagcacccgggggaccagcccgggccccuccgggaucggcgccgucgggggcgaccugcucuaccuggaccugcucaaccgccugcaggcgcuggagagcggcaaggugaagcagucccagcccaaggugaucacgaagaaggacgccgccgccgccaagaacaagaugcggcacaagcgcaccagcaccaaguccuucaacauggugcaggcguucgggcuccggggccccggggaccugcagggcaacuucggggaccugcagcucaacaagcugggcaccgaggacccgcgcuggccccagaucgccgagcuggcccccacggccagcgccuucaugggcaugucccaguucaagcucacccaccagaacaacgacgaccacgggaaccccgucuacuuccugcgguacagcggcgcgaucaagcuggacccgaagaaccccaacuacaacaaguggcucgagcugcuggagcagaacaucgacgccuacaagaccuuccccaagaaggagaagaagcagaaggcccccaaggaggaguccaccgaccagaugagcgagccgcccaaggagcagcgcgugcagggguccaucacgcagcgcacccggacccgccccagcgugcagccgggccccaugaucgacgucaacaccgacuga

SEQ ID NO: 449 - RNA, 1242 nt, Artificial Sequence
  derived and/or modified CDS sequence (opt1) from MERS-CoV__AHY22561__N
auggccagccccgccgcgccgcgcgccguguccuucgccgacaacaacgacaucaccaacaccaaccugagccggggccgcgggcggaaccccaagccccgcgccgcccccaacaacacggucuccugguacaccggccucacccagcacgggaaggugccgcugaccuucccgcccggccagggggugccccugaacgcgaacagcacgcccgcccagaacgccggcuacuggcggcgccaggaccggaagaucaacaccggcaacgggaucaagcagcucgcgccccgcugguacuucuacuacaccggcaccgggcccgaggccgcccugcccuuccgggccgucaaggacggcaucgugugggugcacgaggacggggccacggacgccccguccaccuucggcacccgcaaccccaacaacgacagcgcgaucgucacccaguucgcccccggcacgaagcugcccaagaacuuccacaucgaggggaccggcgggaacucccagagcuccagccgggccuccagcgugucccgcaacagcucccggagcuccagccagggcucccgcagcggcaacagcacccgggggaccuccccgggccccagcgggaucggcgccgucgggggcgaccuccuguaccuggaccuccugaaccgccugcaggcccucgaguccggcaaggugaagcagagccagcccaaggugaucacgaagaaggacgcggccgccgccaagaacaagaugcggcacaagcgcaccuccaccaagagcuucaacauggugcaggccuucgggcugcggggccccggggaccugcagggcaacuucggggaccuccagcugaacaagcugggcaccgaggacccgcgcuggccccagaucgcggagcucgcccccacggccuccgccuucaugggcaugagccaguucaagcugacccaccagaacaacgacgaccacgggaaccccgucuacuuccugcgguacuccggcgccaucaagcucgacccgaagaaccccaacuacaacaaguggcuggagcugcucgagcagaacaucgacgcguacaagaccuuccccaagaaggagaacaagcagaaggcccccaaggaggagagcaccgaccagauguccgagccgcccaaggagcagcgcgugcaggggagcaucacgcagcgcacccggacccgccccuccgugcagccgggccccaugaucgacgucaacaccgacuga

SEQ ID NO: 450 - RNA, 1242 nt, Artificial Sequence
  derived and/or modified CDS sequence (opt1) from MERS-CoV__AHY22571__N
auggccgcccccgcggccccgcgcgccgugagcuucgccgacaacaacgacaucaccaacaccaaccugucccggggccgcgggcggaaccccaagccccgcgccgcgcccaacaacacggucagcugguacaccggccucacccagcacgggaaggugccgcugaccuucccgcccggccagggggugccccugaacgccaacuccacgcccgcccagaacgccggcuacuggcggcgccaggaccggaagaucaacaccggcaacgggaucaagcagcucgcgccccgcugguacuucuacuacaccggcaccgggcccgaggccgcccugcccuuccgggccgucaaggacggcaucgugugggugcacgaggacggggccacggacgcgccgagcaccuucggcacccgcaaccccaacaacgacuccgccaucgucacccaguucgcccccggcacgaagcugcccaagaacuuccacaucgaggggaccggcgggaacagccaguccagcucccgggccagcuccgugagccgcaacuccagccgguccagcucccagggcagccgcucccggaacagcacccgcggcaccagcccggggcccuccggcaucggggccgugggcggggaccuccuguaccuggaccuccugaaccggcugcaggcgcucgagagcggcaaggucaagcagucccagcccaaggugaucacgaagaaggacgccgccgccgccaagaacaagaugcgccacaagcggaccagcaccaaguccuucaacauggugcaggcguucggccugcgcgggcccggcgaccugcaggggaacuucggcgaccuccagcugaacaagcuggggaccgaggacccgcgguggccccagaucgccgagcucgcccccacggccagcgccuucaugggcaugucccaguucaagcugacccaccagaacaacgacgaccacggcaaccccgucuacuuccugcgcuacagcggggcgaucaagcucgacccgaagaaccccaacuacaacaaguggcuggagcugcucgagcagaacaucgacgccuacaagaccuuccccaagaaggagaacaagcagaaggcccccaaggaggaguccaccgaccagaugagcgagccgcccaaggagcagcgcgugcagggcuccaucacgcagcggacccgcacccggcccagcgugcagccggggcccaugaucgacgucaacaccgacuga

SEQ ID NO: 451 - RNA, 1242 nt, Artificial Sequence
  derived and/or modified CDS sequence (opt1) from MERS-CoV__ALA49381__N
auggccagccccgccgcgccgcgcgccguguccuucgccgacaacaacgacaucaccaacaccaaccugagccggggccgcgggcggaaccccaagccccgcgccgcccccaacaacacggucuccugguacaccggccucacccagcacgggaaggugccgcugaccuucccgcccggccagggggugccccugaacgcgaacagcacgcccgcccagaacgccggcuacuggcggcgccaggaccggaagaucaacaccggcaacgggaucaagcagcucgcgccccgcugguacuucuacuacaccggcaccgggcccgaggccgcccugcccuuccgggccgucaaggacggcaucgugugggugcacgaggacggggccacggacgccccguccaccuucggcacccgcaaccccaacaacgacagcgcgaucgucacccaguucgcccccggcacgaagcugcccaagaacuuccacaucgaggggaccggcgggaacucccagagcuccagccgggccuccagcgugucccgcaacagcucccggagcuccagccagggcucccgcagcggcaacagcacccggggguccagcccgggccccuccgggaucggcgccgucgggggcgaccuccuguaccuggaccuccugaaccgccugcaggcccucgagagcggcaaggugaagcagucccagcccaaggugaucaccaagaaggacgcggccgccgccaagaacaagaugcggcacaagcgcacgagcaccaaguccuucaacauggugcaggccuucgggcugcggggccccggggaccugcagggcaacuucggggaccuccagcugaacaagcugggcaccgaggacccgcgcuggccccagaucgcggagcucgcccccaccgccagcgccuucaugggcaugucccaguucaagcugacgcaccagaacaacgacgaccacgggaaccccgucuacuuccugcgguacagcggcgccaucaagcucgacccgaagaaccccaacuacaacaaguggcuggagcugcucgagcagaacaucgacgcguacaagaccuuccccaagaaggagaagaagcagaaggcccccaaggaggaguccaccgaccagaugagcgagccgcccaaggagcagcgcgugcagggguccaucacccagcgcacgcggacccgccccagcgugcagccgggccccaugaucgacgucaacaccgacuga

SEQ ID NO: 452 - RNA, 1242 nt, Artificial Sequence
  derived and/or modified CDS sequence (opt1) from MERS-CoV__ALA49392__N
auggccagccccgccgcgccgcgcgccguguccuucgccgacaacaacgacaucaccaacaccaaccugagccggggccgcgggcggaaccccaagccccgcgccgcccccaacaacacggucuccugguacaccggccucacccagcacgggaaggugccgcugaccuucccgcccggccagggggugccccugaacgcgaacagcacgcccgcccagaacgccggcuacuggcggcgccaggaccggaagaucaacaccggcaacgggaucaagcagcucgcgccccgcugguacuucuacuacaccggcaccgggcccgaggccgcccugcccuuccgggccgucaaggacggcaucgugugggugcacgaggacggggccacggacgccccguccaccuucggcacccgcaaccccaacaacgacagcgcgaucgucacccaguucgcccccggcacgaagcugcccaagaacuuccacaucgaggggaccggcgggaacucccagagcuccagccgggccuccagcgugucccgcaacagcucccggagcuccagccagggcucccgcagcggcaacagcacccggggguccagcccgggccccuccgggaucggcgccgucgggggcgaccuccuguaccuggaccuccugaaccgccugcaggcccucgagagcggcaaggugaagcagucccagcccaaggugaucaccaagaaggacgcggccgccgccaagaacaagaugcggcacaagcgcacgagcaccaaguccuucaacauggugcaggccuucgggcugcggggccccggggaccugcagggcaacuucggggaccuccagcugaacaagcugggcaccgaggacccgcgcuggccccagaucgcggagcucgcccccaccgccagcgccuucaugggcaugucccaguucaagcugacgcaccagaacaacgacgaccacgggaaccccgucuacuuccugcgguacagcggcgccaucaagcucgacccgaagaaccccaacuacaacaaguggcuggagcugcucgagcagaacaucgacgcguacaagaccuuccccaagaaggagaagaagcagaaggcccccaaggaggaguccaccgaccagaugagcgagccgcccaaggagcagcgcgugcgcggguccaucacccagcggacgcgcacccggcccagcgugcagccgggccccaugaucgacgucaacaccgacuga

SEQ ID NO: 453 - RNA, 1242 nt, Artificial Sequence
  derived and/or modified CDS sequence (opt1) from MERS-CoV__ALA49601__N
auggccagccccgccgcgccgcgcgccguguccuucgccgacaacaacgacaucaccaacaccaaccugagccggggccgcgggcggaaccccaagccccgcgccgcccccaacaacacggucuccugguacaccggccucacccagcacgggaaggugccgcugaccuucccgcccggccagggggugccccugaacgcgaacagcacgcccgcccagaacgccggcuacuggcggcgccaggaccggaagaucaacaccggcaacgggaucaagcagcucgcgccccgcugguacuucuacuacaccggcaccgggcccgaggccgcccugcccuuccgggccgucaaggacggcaucgugugggugcacgaggacggggccacggacgccccguccaccuucggcacccgcaaccccaacaacgacagcgcgaucgucacccaguucgcccccggcacgaagcugcccaagaacuuccacaucgaggggaccggcgggaacucccagagcuccagccgggccuccagcgugucccgcaacagcucccggagcuccagccagggcucccgcagcggcaacagcacccgggggaccuccccgggccucagcgggaucggcgccgucgggggcgaccugcuguaccucgaccugcugaaccgccuccaggcccuggaguccggcaaggugaagcagagccagcccaaggugaucacgaagaaggacgcggccgccgccaagaacaagaugcggcacaagcgcaccuccaccaagagcuucaacauggugcaggccuucgggcugcggggccccggggaccuccagggcaacuucggggaccugcagcugaacaagcucggcaccgaggacccccgcuggccgcagaucgcggagcuggcccccacggccuccgccuucaugggcaugagccaguucaagcugacccaccagaacaacgacgaccacgggaaccccgucuacuuccuccgguacuccggcgccaucaagcuggaccccaagaacccgaacuacaacaaguggcuggagcuccuggagcagaacaucgacgcguacaagaccuuccccaagaaggagaagaagcagaaggcccccaaggaggagagcaccgaccagauguccgagcccccgaaggagcagcgcgugcaggggagcaucacgcagcgcacccggacccgccccuccgugcagcccggcccgaugaucgacgucaacaccgacuga

SEQ ID NO: 454 - RNA, 1242 nt, Artificial Sequence
  derived and/or modified CDS sequence (opt1) from MERS-CoV__ALA49843__N
auggccagccccgccgcgccgcgcgccguguccuucgccgacaacaacgacaucaccaacaccaaccugagccggggccgcgggcggaaccccaagccccgcgccgcccccaacaacacggucuccugguacaccggccucacccagcacgggaaggugccgcugaccuucccgcccggccagggggugccccugaacgcgaacagcacgcccgcccagaacgccggcuacuggcggcgccaggaccggaagaucaacaccggcaacgggaucaagcagcucgcgccccgcugguacuucuacuacaccggcaccgggcccgaggccgcccugcccuuccgggccgucaaggacggcaucgugugggugcacgaggacggggccacggacgccccguccaccuucggcacccgcaaccccaacaacgacagcgcgaucgucacccaguucgcccccggcacgaagcugcccaagaacuuccacaucgaggggaccggcgggaacucccagagcuccagccgggccuccagcgugucccgcaacagcucccggagcuccagccagggcucccgcagcggcaacagcacccggugcaccuccccggggcccagcggcaucggggccgugggcggggaccuccuguaccuggaccuccugaaccgccugcaggcccucgaguccggcaaggucaagcagagccagcccaaggugaucacgaagaaggacgcggccgccgccaagaacaagaugcggcacaagcgcaccuccaccaagagcuucaacauggugcaggccuucggccugcgggggcccggcgaccugcaggggaacuucggcgaccuccagcugaacaagcuggggaccgaggacccgcgcuggccccagaucgcggagcucgcccccacggccuccgccuucaugggcaugagccaguucaagcugacccaccagaacaacgacgaccacggcaaccccgucuacuuccugcgguacuccggggccaucaagcucgacccgaagaaccccaacuacaacaaguggcuggagcugcucgagcagaacaucgacgcguacaagaccuuccccaagaaggagaagaagcagaaggcccccaaggaggagagcaccgaccagauguccgagccgcccaaggagcagcgcgugcagggcagcaucacgcagcgcacccggacccgccccuccgugcagccggggcccaugaucgacgucaacaccgacuga

SEQ ID NO: 455 - RNA, 1242 nt, Artificial Sequence
  derived and/or modified CDS sequence (opt1) from MERS-CoV__ALA49865__N
auggccagccccgccgcgccgcgcgccguguccuucgccgacaacaacgacaucaccaacaccaaccugagccggggccgcgggcggaaccccaagccccgcgccgcccccaacaacacggucuccugguacaccggccucacccagcacgggaaggugccgcugaccuucccgcccggccagggggugccccugaacgcgaacagcacgcccgcccagaacgccggcuacuggcggcgccaggaccggaagaucaacaccggcaacgggaucaagcagcucgcgccccgcugguacuucuacuacaucggcaccgggcccgaggccgcccugcccuuccgggccgucaaggacggcaucgugugggugcacgaggacggggccaccgacgccccguccacguucggcacccgcaaccccaacaacgacagcgcgaucgucacccaguucgcccccggcaccaagcugcccaagaacuuccacaucgaggggacgggcgggaacucccagagcuccagccgggccuccagcgugucccgcaacagcucccggagcuccagccagggcucccgcagcggcaacagcacccgggggaccuccccgggccccagcgggaucggcgccgucgggggcgaccuccuguaccuggaccuccugaaccgccugcaggcccucgaguccggcaaggugaagcagagccagcccaaggugaucaccaagaaggacgcggccgccgccaagaacaagaugcggcacaagcgcacguccaccaagagcuucaacauggugcaggccuucgggcugcggggccccggggaccugcagggcaacuucggggaccuccagcugaacaagcugggcaccgaggacccgcgcuggccccagaucgcggagcucgcccccaccgccuccgccuucaugggcaugagccaguucaagcugacgcaccagaacaacgacgaccacgggaaccccgucuacuuccugcgguacuccggcgccaucaagcucgacccgaagaaccccaacuacaacaaguggcuggagcugcucgagcagaacaucgacgcguacaagaccuuccccaagaaggagaagaagcagaaggcccccaaggaggagagcaccgaccagauguccgagccgcccaaggagcagcgcgugcaggggagcaucacccagcgcacgcggacccgccccuccgugcagccgggccccaugaucgacgucaacaccgacuga

SEQ ID NO: 456 - RNA, 1242 nt, Artificial Sequence
  derived and/or modified CDS sequence (opt1) from MERS-CoV__ALA49909__N
auggccagccccgccgcgccgcgcgccguguccuucgccgacaacaacgacaucaccaacaccaaccugagccggggccgcgggcggaaccccaagccccgcgccgcccccaacaacacggucuccugguacaccggccucacccagcacgggaaggugccgcugaccuucccgcccggccagggggugccccugaacgcgaacagcacgcccgcccagaacgccggcuacuggcggcgccaggaccggaagaucaacaccggcaacgggaucaagcagcucgcgccccgcugguacuucuacuacaccggcaccgggcccgaggccgcccugcccuuccgggccgucaaggacggcaucgugugggugcacgagcacggggccacggacgccccguccaccuucggcacccgcaaccccaacaacgacagcgcgaucgucacccaguucgcccccggcacgaagcugcccaagaacuuccacaucgaggggaccggcgggaacucccagagcuccagccgggccuccagcgugucccgcaacagcucccggagcuccagccagggcucccgcagcggcaacagcacccggugcaccuccccggggcccagcggcaucggggccgugggcggggaccuccuguaccuggaccuccugaaccgccugcaggcccucgaguccggcaaggucaagcagagccagcccaaggugaucacgaagaaggacgcggccgccgccaagaacaagaugcggcacaagcgcaccuccaccaagagcuucaacauggugcaggccuucggccugcgggggcccggcgaccugcaggggaacuucggcgaccuccagcugaacaagcuggggaccgaggacccgcgcuggccccagaucgcggagcucgcccccacggccuccgccuucaugggcaugagccaguucaagcugacccaccagaacaacgacgaccacggcaaccccgucuacuuccugcgguacuccggggccaucaagcucgacccgaagaaccccaacuacaacaaguggcuggagcugcucgagcagaacaucgacgcguacaagaccuuccccaagaaggagaagaagcagaaggcccccaaggaggagagcaccgaccagauguccgagccgcccaaggagcagcgcgugcagggcagcaucacgcagcgcacccggacccgccccuccgugcagccggggcccaugaucgacgucaacaccgacuga

SEQ ID NO: 457 - RNA, 4062 nt, Artificial Sequence
  derived and/or modified CDS sequence (opt2) from MERS-CoV__AFS88936__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccagaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 458 - RNA, 4062 nt, Artificial Sequence
  derived and/or modified CDS sequence (opt2) from MERS-CoV__AFY13307__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgcuuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccacaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 459 - RNA, 4062 nt, Artificial Sequence
  derived and/or modified CDS sequence (opt2) from MERS-CoV__AGH58717__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccgucaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaacuacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccucuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccagaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacuccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 460 - RNA, 4062 nt, Artificial Sequence
  derived and/or modified CDS sequence (opt2) from MERS-CoV__AGN52936__S
augauccacuccgucuuccuccucauguuccuccucacccccaccgaguccuacgucgacgucggccccgacuccaucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccacaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 461 - RNA, 4062 nt, Artificial Sequence
  derived and/or modified CDS sequence (opt2) from MERS-CoV__AGN70951__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccacgucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 462 - RNA, 4062 nt, Artificial Sequence
  derived and/or modified CDS sequence (opt2) from MERS-CoV__AGV08408__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccggcgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 463 - RNA, 4062 nt, Artificial Sequence
  derived and/or modified CDS sequence (opt2) from MERS-CoV__AGV08455__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccuacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 464 - RNA, 4062 nt, Artificial Sequence
  derived and/or modified CDS sequence (opt2) from MERS-CoV__AGV08467__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaucggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 465 - RNA, 4062 nt, Artificial Sequence
  derived and/or modified CDS sequence (opt2) from MERS-CoV__AGV08492__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucucccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccacgucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 466 - RNA, 4062 nt, Artificial Sequence
  derived and/or modified CDS sequence (opt2) from MERS-CoV__AGV08584__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgccugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 467 - RNA, 4062 nt, Artificial Sequence
  derived and/or modified CDS sequence (opt2) from MERS-CoV__AHB33326__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccuacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcaccagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacucccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 468 - RNA, 4062 nt, Artificial Sequence
  derived and/or modified CDS sequence (opt2) from MERS-CoV__AHC74088__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuucgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 469 - RNA, 4062 nt, Artificial Sequence
  derived and/or modified CDS sequence (opt2) from MERS-CoV__AHI48528__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucuccccccccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgucaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 470 - RNA, 4062 nt, Artificial Sequence
  derived and/or modified CDS sequence (opt2) from MERS-CoV__AHI48550__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccacaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccuccagccccacaagguccacguccacuga

SEQ ID NO: 471 - RNA, 4062 nt, Artificial Sequence
  derived and/or modified CDS sequence (opt2) from MERS-CoV__AHI48583__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuucaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccacaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 472 - RNA, 4062 nt, Artificial Sequence
  derived and/or modified CDS sequence (opt2) from MERS-CoV__AHI48605__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccacaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 473 - RNA, 4062 nt, Artificial Sequence
  derived and/or modified CDS sequence (opt2) from MERS-CoV__AHY21469__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccgucaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaacuacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccucuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaccuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccagaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacuccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 474 - RNA, 4062 nt, Artificial Sequence
  derived and/or modified CDS sequence (opt2) from MERS-CoV__AHZ64057__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuucuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccgcgcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 475 - RNA, 4062 nt, Artificial Sequence
  derived and/or modified CDS sequence (opt2) from MERS-CoV__AID50418__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 476 - RNA, 4062 nt, Artificial Sequence
  derived and/or modified CDS sequence (opt2) from MERS-CoV__AID55068__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccgcgcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 477 - RNA, 4062 nt, Artificial Sequence
  derived and/or modified CDS sequence (opt2) from MERS-CoV__AID55073__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaacuucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 478 - RNA, 4062 nt, Artificial Sequence
  derived and/or modified CDS sequence (opt2) from MERS-CoV__AIY60528__S
augauccacuccgucuuccuccucauguuccuccucacccccaccgaguccuacgucgacgucggccccgacuccuucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccagaacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacucccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 479 - RNA, 4062 nt, Artificial Sequence
  derived and/or modified CDS sequence (opt2) from MERS-CoV__AIY60558__S
augauccacuccgucuuccuccucauguuccuccucacccccaccgaguccuacgucgacgucggccccgacuccuucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacucccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 480 - RNA, 4062 nt, Artificial Sequence
  derived and/or modified CDS sequence (opt2) from MERS-CoV__AIZ74450__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcaccagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacucccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 481 - RNA, 4062 nt, Artificial Sequence
  derived and/or modified CDS sequence (opt2) from MERS-CoV__AJD81440__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucaaccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 482 - RNA, 4062 nt, Artificial Sequence
  derived and/or modified CDS sequence (opt2) from MERS-CoV__AKI29284__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgccuucuucauccucugcugcaccggcugcggcaccaacugcaugggcaagcucaagugcaaccgcugcugcgaccgcuacgaggaguacgaccucgagccccacaagguccacguccacuga

SEQ ID NO: 483 - RNA, 4062 nt, Artificial Sequence
  derived and/or modified CDS sequence (opt2) from MERS-CoV__AKL59401__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccacccgcgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccauccuccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 484 - RNA, 4062 nt, Artificial Sequence
  derived and/or modified CDS sequence (opt2) from MERS-CoV__AKM76229__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccccccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacaucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacucccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 485 - RNA, 4062 nt, Artificial Sequence
  derived and/or modified CDS sequence (opt2) from MERS-CoV__AKM76239__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgagcucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacaucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgucgccaaccccaccaacugcaucgcccccgucaacggcuacuucaucaagaccaacaacacccgcaucgucgacgagugguccuacaccggcuccuccuucuacucccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacuucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 486 - RNA, 4062 nt, Artificial Sequence
  derived and/or modified CDS sequence (opt2) from MERS-CoV__AKN11072__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaccguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 487 - RNA, 4062 nt, Artificial Sequence
  derived and/or modified CDS sequence (opt2) from MERS-CoV__AKN11074__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaccguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcacuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 488 - RNA, 4062 nt, Artificial Sequence
  derived and/or modified CDS sequence (opt2) from MERS-CoV__AKN24803__S
augguccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaacuucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucucccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 489 - RNA, 4062 nt, Artificial Sequence
  derived and/or modified CDS sequence (opt2) from MERS-CoV__AKN24812__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucugcgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaacuucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccugcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaaguccaaccgcugcugcgaccgcuacgaggaguacgaccucgagccccacaagguccacguccacuga

SEQ ID NO: 490 - RNA, 4062 nt, Artificial Sequence
  derived and/or modified CDS sequence (opt2) from MERS-CoV__AKN24830__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaacuucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggccccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 491 - RNA, 4062 nt, Artificial Sequence
  derived and/or modified CDS sequence (opt2) from MERS-CoV__ALB08257__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccgccgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 492 - RNA, 4062 nt, Artificial Sequence
  derived and/or modified CDS sequence (opt2) from MERS-CoV__ALB08311__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggcuacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacggccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 493 - RNA, 4062 nt, Artificial Sequence
  derived and/or modified CDS sequence (opt2) from MERS-CoV__ALB08322__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggcuacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacggccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagcuccacaagguccacguccacuga

SEQ ID NO: 494 - RNA, 4062 nt, Artificial Sequence
  derived and/or modified CDS sequence (opt2) from MERS-CoV__ALD51904__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcgccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 495 - RNA, 4062 nt, Artificial Sequence
  derived and/or modified CDS sequence (opt2) from MERS-CoV__ALJ54446__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuucuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaucugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 496 - RNA, 4062 nt, Artificial Sequence
  derived and/or modified CDS sequence (opt2) from MERS-CoV__ALJ54448__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccauccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 497 - RNA, 4062 nt, Artificial Sequence
  derived and/or modified CDS sequence (opt2) from MERS-CoV__ALJ54450__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcuacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucuccaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 498 - RNA, 4062 nt, Artificial Sequence
  derived and/or modified CDS sequence (opt2) from MERS-CoV__ALJ54453__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaacuacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 499 - RNA, 4062 nt, Artificial Sequence
  derived and/or modified CDS sequence (opt2) from MERS-CoV__ALJ54455__S
augauccacuccgucuuccuccucauguuccuccucacccccaccgaguccuacgucgacgucggccccgacuccgucaaguccgccugcaucgccgucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaagcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaagccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 500 - RNA, 4062 nt, Artificial Sequence
  derived and/or modified CDS sequence (opt2) from MERS-CoV__ALJ54456__S
augauccacuccgucuuccuccucauguuccuccucacccccaccgaguccuacgucgacgucggccccgacuccgucaaguccgccugcaucgccgucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaagccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 501 - RNA, 4062 nt, Artificial Sequence
  derived and/or modified CDS sequence (opt2) from MERS-CoV__ALJ54461__S
augauccacuccgucuuccuccucauguuccuccucacccccaccgaguccuacgucgacgucggccccgacuccgucaagcccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucaccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagaccuccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 502 - RNA, 4062 nt, Artificial Sequence
  derived and/or modified CDS sequence (opt2) from MERS-CoV__ALJ54468__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaucugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 503 - RNA, 4062 nt, Artificial Sequence
  derived and/or modified CDS sequence (opt2) from MERS-CoV__ALJ54471__S
augauccacuccgucuaccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccacaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 504 - RNA, 4062 nt, Artificial Sequence
  derived and/or modified CDS sequence (opt2) from MERS-CoV__ALJ54472__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccuccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucgccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucucccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 505 - RNA, 4062 nt, Artificial Sequence
  derived and/or modified CDS sequence (opt2) from MERS-CoV__ALJ54474__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccuccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcgucgucgacgagugguccuacaccggcuccuccuucuacgcccccgagcccaucaccucccucaacaccaaguacgucgccccccaggucaccuaccagaacaucuccaccaaccucccccccccccuccucuccaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 506 - RNA, 4062 nt, Artificial Sequence
  derived and/or modified CDS sequence (opt2) from MERS-CoV__ALJ54483__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucuuccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 507 - RNA, 4062 nt, Artificial Sequence
  derived and/or modified CDS sequence (opt2) from MERS-CoV__ALJ54486__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcuacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgucuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucuccaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 508 - RNA, 4062 nt, Artificial Sequence
  derived and/or modified CDS sequence (opt2) from MERS-CoV__ALJ54488__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacaucuacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 509 - RNA, 4062 nt, Artificial Sequence
  derived and/or modified CDS sequence (opt2) from MERS-CoV__ALJ54490__S
augauccacuccgucuuccuccucauguuccuccucacccccaccgaguccuacgucgacgucggccccgacuccgucaaguccgccugcaucgccgucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacggccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaagccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 510 - RNA, 4062 nt, Artificial Sequence
  derived and/or modified CDS sequence (opt2) from MERS-CoV__ALJ54495__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgucuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcauccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 511 - RNA, 4062 nt, Artificial Sequence
  derived and/or modified CDS sequence (opt2) from MERS-CoV__ALJ54496__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccccuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgacugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 512 - RNA, 4062 nt, Artificial Sequence
  derived and/or modified CDS sequence (opt2) from MERS-CoV__ALJ54500__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucucccuccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 513 - RNA, 4062 nt, Artificial Sequence
  derived and/or modified CDS sequence (opt2) from MERS-CoV__ALJ54501__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccacccucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 514 - RNA, 4062 nt, Artificial Sequence
  derived and/or modified CDS sequence (opt2) from MERS-CoV__ALJ54502__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccguccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaaguucaaccgcugcugcgaccgcuacgaggaguacgaccucgagccccacaagguccacguccacuga

SEQ ID NO: 515 - RNA, 4062 nt, Artificial Sequence
  derived and/or modified CDS sequence (opt2) from MERS-CoV__ALJ54512__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcgcccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 516 - RNA, 4062 nt, Artificial Sequence
  derived and/or modified CDS sequence (opt2) from MERS-CoV__ALJ54517__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcaacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccacccgcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 517 - RNA, 4062 nt, Artificial Sequence
  derived and/or modified CDS sequence (opt2) from MERS-CoV__ALJ54518__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccccuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 518 - RNA, 4062 nt, Artificial Sequence
  derived and/or modified CDS sequence (opt2) from MERS-CoV__ALW82691__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccgcuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 519 - RNA, 4062 nt, Artificial Sequence
  derived and/or modified CDS sequence (opt2) from MERS-CoV__ALW82742__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccagaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 520 - RNA, 4062 nt, Artificial Sequence
  derived and/or modified CDS sequence (opt2) from MERS-CoV__ALW82753__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccuccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucggccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucuccaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 521 - RNA, 4062 nt, Artificial Sequence
  derived and/or modified CDS sequence (opt2) from MERS-CoV__ALX27228__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucuggaaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucuccugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 522 - RNA, 4062 nt, Artificial Sequence
  derived and/or modified CDS sequence (opt2) from MERS-CoV__ALX27232__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccuacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgacgucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 523 - RNA, 4062 nt, Artificial Sequence
  derived and/or modified CDS sequence (opt2) from MERS-CoV__AMQ48993__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaucgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucacccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucuccaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 524 - RNA, 4062 nt, Artificial Sequence
  derived and/or modified CDS sequence (opt2) from MERS-CoV__AMW90844__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccuuccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 525 - RNA, 4062 nt, Artificial Sequence
  derived and/or modified CDS sequence (opt2) from MERS-CoV__AMW90852__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaacuucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgacuucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 526 - RNA, 4062 nt, Artificial Sequence
  derived and/or modified CDS sequence (opt2) from MERS-CoV__AMW90853__S
augauccacuccgucuuccuccucauguuccuccucacccccaccgaguccuacgucgacgucggcuccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggcuacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaacuucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 527 - RNA, 4062 nt, Artificial Sequence
  derived and/or modified CDS sequence (opt2) from MERS-CoV__ANC28656__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacggccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 528 - RNA, 4062 nt, Artificial Sequence
  derived and/or modified CDS sequence (opt2) from MERS-CoV__ANC28678__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccaucugcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacggccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 529 - RNA, 4059 nt, Artificial Sequence
  derived and/or modified CDS sequence (opt2) from MERS-CoV__AHL18090__S
augauccacuccgucuuccuccucauguuccuccucacccccaccgaguccuacgucgacgucggccucgacuccgccaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaacuacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucuccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaagaagaccaagacccacgccacccucuucggcuccgucgccugcgagcacaucuccuccaccaugucccaguacucccgcuccacccgcuccacccucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggccagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccucccgcaucgccaucgaggaccuccucuucgacaaggucaccaucgccgaccccggcuacaugcagggcuacgacgacugcaugcagcagggccccuccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccagaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacuccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaaguggcccugguacaucuggcucggcuucaucgccggccucgucgcccucgcccucugcgucuucuucauccucugcugcaccggcugcggcaccaacugcaugggcaagcucaagcgcaaccgcugcugcgaccgcuacgaggaguacgaccucgagccccacaagguccacguccacuga

SEQ ID NO: 530 - RNA, 4062 nt, Artificial Sequence
  derived and/or modified CDS sequence (opt2) from MERS-CoV__AHX00731__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucggcgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccaguucaacuccuccuacuucaagcucuccauccccaccaacuucuccuucggcgucacccaggaguacauccagaccaccauccagaaggucaccgucgacugcaagcaguacaucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacucccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 531 - RNA, 4062 nt, Artificial Sequence
  derived and/or modified CDS sequence (opt2) from MERS-CoV__AHX71946__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacucccacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 532 - RNA, 4062 nt, Artificial Sequence
  derived and/or modified CDS sequence (opt2) from MERS-CoV__AHY22545__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaaccgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 533 - RNA, 4062 nt, Artificial Sequence
  derived and/or modified CDS sequence (opt2) from MERS-CoV__AHY22555__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaacuacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccuccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacuccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccacaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 534 - RNA, 4062 nt, Artificial Sequence
  derived and/or modified CDS sequence (opt2) from MERS-CoV__AHY22565__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaucauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccuccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccuccaaccccaccaacugcaucgcccccgucaacggcuacuucaucaagaccaacaacacccgcaucgucgacgagugguccuacaccggcuccuccuucuacucccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 535 - RNA, 4062 nt, Artificial Sequence
  derived and/or modified CDS sequence (opt2) from MERS-CoV__AJG44069__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccgcaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccccccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacaucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacucccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 536 - RNA, 4062 nt, Artificial Sequence
  derived and/or modified CDS sequence (opt2) from MERS-CoV__AJG44080__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccaucaaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccccccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacaucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacucccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 537 - RNA, 4062 nt, Artificial Sequence
  derived and/or modified CDS sequence (opt2) from MERS-CoV__AJG44102__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucucccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaucucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacucccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 538 - RNA, 4062 nt, Artificial Sequence
  derived and/or modified CDS sequence (opt2) from MERS-CoV__AJG44124__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccauguuccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacucccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 539 - RNA, 4062 nt, Artificial Sequence
  derived and/or modified CDS sequence (opt2) from MERS-CoV__ALL26396__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuccgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucuccaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 540 - RNA, 4062 nt, Artificial Sequence
  derived and/or modified CDS sequence (opt2) from MERS-CoV__ALS20350__S
augauccacuccgucuuccuccucauguuccuccucacccccaccgaguccuacgucgacgucggccccgacuccgccaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaacuacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucaccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccuaccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcaccagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccagaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgaccucgccaaccccaccaacugcaucgcccccgucaacggcuacuucaucaagaccaacaacacccgcaucgucgacgagugguccuacaccggcuccuccuucuacgcccccgagcccaucaccuccuucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 541 - RNA, 4062 nt, Artificial Sequence
  derived and/or modified CDS sequence (opt2) from MERS-CoV__ALT66880__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacucccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 542 - RNA, 4062 nt, Artificial Sequence
  derived and/or modified CDS sequence (opt2) from MERS-CoV__ALA49341__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccacccuccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaucugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 543 - RNA, 4062 nt, Artificial Sequence
  derived and/or modified CDS sequence (opt2) from MERS-CoV__ALA49352__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuacuacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 544 - RNA, 4062 nt, Artificial Sequence
  derived and/or modified CDS sequence (opt2) from MERS-CoV__ALA49363__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccaccuuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 545 - RNA, 4062 nt, Artificial Sequence
  derived and/or modified CDS sequence (opt2) from MERS-CoV__ALA49374__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaacuucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucuccaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 546 - RNA, 4062 nt, Artificial Sequence
  derived and/or modified CDS sequence (opt2) from MERS-CoV__ALA49396__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuccuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucuccaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 547 - RNA, 4062 nt, Artificial Sequence
  derived and/or modified CDS sequence (opt2) from MERS-CoV__ALA49451__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaaccucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 548 - RNA, 4062 nt, Artificial Sequence
  derived and/or modified CDS sequence (opt2) from MERS-CoV__ALA49473__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccaccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaaguucaaccgcugcugcgaccgcuacgaggaguacgaccucgagccccacaagguccacguccacuga

SEQ ID NO: 549 - RNA, 4062 nt, Artificial Sequence
  derived and/or modified CDS sequence (opt2) from MERS-CoV__ALA49583__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaaguucaaccgcugcugcgaccgcuacgaggaguacgaccucgagccccacaagguccacguccacuga

SEQ ID NO: 550 - RNA, 4062 nt, Artificial Sequence
  derived and/or modified CDS sequence (opt2) from MERS-CoV__ALA49649__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccacccccaagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccauccccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccacaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucuccaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 551 - RNA, 4062 nt, Artificial Sequence
  derived and/or modified CDS sequence (opt2) from MERS-CoV__ALA49660__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaaguucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgacaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucuccaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 552 - RNA, 4062 nt, Artificial Sequence
  derived and/or modified CDS sequence (opt2) from MERS-CoV__ALA49671__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccaacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgacaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucuccaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 553 - RNA, 4062 nt, Artificial Sequence
  derived and/or modified CDS sequence (opt2) from MERS-CoV__ALA49682__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucuccaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 554 - RNA, 4062 nt, Artificial Sequence
  derived and/or modified CDS sequence (opt2) from MERS-CoV__ALA49803__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgaccgcuacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccuccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcgucgucgacgagugguccuacaccggcuccuccuucuacgcccccgagcccaucaccucccucaacaccaaguacgucgccccccaggucaccuaccagaacaucuccaccaaccucccccccccccuccucuccaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 555 - RNA, 4062 nt, Artificial Sequence
  derived and/or modified CDS sequence (opt2) from MERS-CoV__ALA49836__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuccuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 556 - RNA, 4062 nt, Artificial Sequence
  derived and/or modified CDS sequence (opt2) from MERS-CoV__ALA49957__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacaccaccaucgucgacgagugguccuacaccggcuccuccuucuacgcccccgagcccaucaccucccucaacaccaaguacgucgccccccaggucaccuaccagaacaucuccaccaaccucccccccccccuccucggcaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 557 - RNA, 4062 nt, Artificial Sequence
  derived and/or modified CDS sequence (opt2) from MERS-CoV__ALA50067__S
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccuccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaccccccgcuccguccgcuccguccccggcgagaugcgccucgccuccaucgccuucaaccaccccauccaggucgaccagcucaacuccuccuacuucaagcucuccauccccaccaacuucuccuucggcgucacccaggaguacauccagaccaccauccagaaggucaccgucgacugcaagcaguacgucugcaacggcuuccagaagugcgagcagcuccuccgcgaguacggccaguucugcuccaagaucaaccaggcccuccacggcgccaaccuccgccaggacgacuccguccgcaaccucuucgccuccgucaaguccucccaguccucccccaucauccccggcuucggcggcgacuucaaccucacccuccucgagcccgucuccaucuccaccggcucccgcuccgcccgcuccgccaucgaggaccuccucuucgacaaggucaccaucgccgaccccggcuacaugcagggcuacgacgacugcaugcagcagggccccgccuccgcccgcgaccucaucugcgcccaguacgucgccggcuacaagguccuccccccccucauggacgucaacauggaggccgccuacaccuccucccuccucggcuccaucgccggcgucggcuggaccgccggccucuccuccuucgccgccauccccuucgcccaguccaucuucuaccgccucaacggcgucggcaucacccagcagguccucuccgagaaccagaagcucaucgccaacaaguucaaccaggcccucggcgccaugcagaccggcuucaccaccaccaacgaggccuuccgcaagguccaggacgccgucaacaacaacgcccaggcccucuccaagcucgccuccgagcucuccaacaccuucggcgccaucuccgccuccaucggcgacaucauccagcgccucgacguccucgagcaggacgcccagaucgaccgccucaucaacggccgccucaccacccucaacgccuucgucgcccagcagcucguccgcuccgaguccgccgcccucuccgcccagcucgccaaggacaaggucaacgagugcgucaaggcccaguccaagcgcuccggcuucugcggccagggcacccacaucgucuccuucgucgucaacgcccccaacggccucuacuucaugcacgucggcuacuaccccuccaaccacaucgaggucgucuccgccuacggccucugcgacgccgccaaccccaccaacugcaucgcccccgucaacggcuacuucaucaagaccaacaacacccgcaucgucgacgagugguccuacaccggcuccuccuucuacgcccccgagcccaucaccucccucaacaccaaguacgucgccccccaggucaccuaccagaacaucuccaccaaccucccccccccccuccucuccaacuccaccggcaucgacuuccaggacgagcucgacgaguucuucaagaacgucuccaccuccauccccaacuucggcucccucacccagaucaacaccacccuccucgaccucaccuacgagaugcucucccuccagcaggucgucaaggcccucaacgaguccuacaucgaccucaaggagcucggcaacuacaccuacuacaacaaguggcccugguacaucuggcucggcuucaucgccggccucgucgcccucgcccucugcgucuucuucauccucugcugcaccggcugcggcaccaacugcaugggcaagcucaagugcaaccgcugcugcgaccgcuacgaggaguacgaccucgagccccacaagguccacguccacuga

SEQ ID NO: 558 - RNA, 249 nt, Artificial Sequence
  derived and/or modified CDS sequence (opt2) from MERS-CoV__AGH58723__E
augcuccccuucguccaggagcgcaucggccucuucaucgucaacuucuucaucuucaccgucgucugcgccaucacccuccucgucugcauggccuuccucaccgccacccgccucugcguccagugcaugaccggcuucaacacccuccucguccagcccgcccucuaccucuacaacaccggccgcuccgucuacgucaaguuccaggacuccaagcccccccucccccccgacgagugggucuga

SEQ ID NO: 559 - RNA, 249 nt, Artificial Sequence
  derived and/or modified CDS sequence (opt2) from MERS-CoV__AGV08472__E
augcuccccuucguccaggagcgcgucggccucuucaucgucaacuucuucaucuucaccgucgucugcgccaucacccuccucgucugcauggccuuccucaccgccacccgccucugcguccagugcaugaccggcuucaacacccuccucguccagcccgcccucuaccucuacaacaccggccgcuccgucuacgucaaguuccaggacuccaagcccccccucccccccgacgagugggucuga

SEQ ID NO: 560 - RNA, 249 nt, Artificial Sequence
  derived and/or modified CDS sequence (opt2) from MERS-CoV__AGV08540__E
augcuccccuucguccaggagcgcaucggccucuucaucgucaaguucuucaucuucaccgucgucugcgccaucacccuccucgucugcauggccuuccucaccgccacccgccucugcguccagugcaugaccggcuucaacacccuccucguccagcccgcccucuaccucuacaacaccggccgcuccgucuacgucaaguuccaggacuccaagcccccccucccccccgacgagugggucuga

SEQ ID NO: 561 - RNA, 249 nt, Artificial Sequence
  derived and/or modified CDS sequence (opt2) from MERS-CoV__ALX27237__E
augcuccccuucguccaggagcgcaucggccucuucaucgucaacuucuucaucuucaccgucgucugcgccaucacccuccucgucugcauggccuuccucaccgccacccgccucugcguccagugcaugaccggcuucaacacccuccucguccagcccgcccucuaccucuacaacaccggccgcuccgucuacgucaaguuccaggacuccaagcccccccuccccuccgacgagugggucuga

SEQ ID NO: 562 - RNA, 249 nt, Artificial Sequence
  derived and/or modified CDS sequence (opt2) from MERS-CoV__ALR69646__E
augcuccccuucguccaggagcgcaucggccucuucaucgucaacuucuucaucuucaccgucgucugcgccaucacccuccucgucugcauggccuuccucaccgccacccgccucugcguccagugcaucaccggcuucaacacccuccucguccagcccgcccucuaccucuacaacaccggccgcuccgucuacgucaaguuccaggacuccaagcccccccucccccccgacgagugggucuga

SEQ ID NO: 563 - RNA, 249 nt, Artificial Sequence
  derived and/or modified CDS sequence (opt2) from MERS-CoV__ALA49346__E
augcuccccuucguccaggagcgcaucggccucuucaucgucaacuucuccaucuucaccgucgucugcgccaucacccuccucgucugcauggccuuccucaccgccacccgccucugcguccagugcaugaccggcuucaacacccuccucguccagcccgcccucuaccucuacaacaccggccgcuccgucuacgucaaguuccaggacuccaagcccccccucccccccgacgagugggucuga

SEQ ID NO: 564 - RNA, 249 nt, Artificial Sequence
  derived and/or modified CDS sequence (opt2) from MERS-CoV__ALA49390__E
augcuccccuucguccaggagcgcaucggccucuucaucgucaacuucuucaucuucaccgucgucugcgccaucacccuccucgucugcauggccuuccucaccgccacccgccucugcguccagugcaugaccggccucaacacccuccucguccagcccgcccucuaccucuacaacaccggccgcuccgucuacgucaaguuccaggacuccaagcccccccucccccccgacgagugggucuga

SEQ ID NO: 565 - RNA, 660 nt, Artificial Sequence
  derived and/or modified CDS sequence (opt2) from MERS-CoV__AFS88942__M
auguccaacaugacccagcucaccgaggcccagaucaucgccaucaucaaggacuggaacuucgccuggucccucaucuuccuccucaucaccaucguccuccaguacggcuaccccucccgcuccaugaccgucuacgucuucaagauguucguccucuggcuccucuggcccuccuccauggcccucuccaucuucuccgccgucuaccccaucgaccucgccucccagaucaucuccggcaucgucgccgccgucuccgccaugauguggaucuccuacuucguccaguccauccgccucuucaugcgcaccggcuccuggugguccuucaaccccgagaccaacugccuccucaacguccccuucggcggcaccaccgucguccgcccccucgucgaggacuccaccuccgucaccgccgucgucaccaacggccaccucaagauggccggcaugcacuucggcgccugcgacuacgaccgccuccccaacgaggucaccgucgccaagcccaacguccucaucgcccucaagauggucaagcgccaguccuacggcaccaacuccggcgucgccaucuaccaccgcuacaaggccggcaacuaccgcuccccccccaucaccgccgacaucgagcucgcccuccuccgcgccuga

SEQ ID NO: 566 - RNA, 660 nt, Artificial Sequence
  derived and/or modified CDS sequence (opt2) from MERS-CoV__AGH58718__M
auguccaacaugacccagcucaccgaggcccagaucaucgccgucaucaaggacuggaacuucgccuggucccucaucuuccuccucaucaccaucguccuccaguacggcuaccccucccgcuccaugaccgucuacgucuucaagauguucguccucuggcuccucuggcccuccuccauggcccucuccaucuucuccaccgucuaccccaucgaccucgccucccagaucaucuccggcaucgucgccgccgucuccgccaugauguggaucuccuacuucguccaguccauccgccucuucaugcgcaccggcuccuggugguccuucaaccccgagaccaacugccuccucaacguccccuucggcggcaccaccgucguccgcccccucgucgaggacuccaccuccgucaccgccgucgucaccaacggccaccucaagauggccggcaugcacuucggcgccugcgacuacgaccgccuccccaacgaggucaccgucgccaagcccaacguccucaucgcccucaagauggucaagcgccaguccuacggcaccaacuccggcgucgccaucuaccaccgcuacaaggccggcaacuaccgcuccccccccaucaccgccgacaucgagcucgcccuccuccgcgccuga

SEQ ID NO: 567 - RNA, 660 nt, Artificial Sequence
  derived and/or modified CDS sequence (opt2) from MERS-CoV__AGV08396__M
auguccaacaugacccagcucaccgaggcccagaucaucgccaucaucaaggacuggaacuucgccuggucccucaucuuccuccucaucaccaucguccuccaguacggcuaccccucccgcuccaugaccgucuacgucuucaagauguucguccucuggcuccucuggcccuccuccauggcccucuccaucuucuccgccaucuaccccaucgaccucgccucccagaucaucuccggcaucgucgccgccgucuccgccaugauguggaucuccuacuucguccaguccauccgccucuucaugcgcaccggcuccuggugguccuucaaccccgagaccaacugccuccucaacguccccuucggcggcaccaccgucguccgcccccucgucgaggacuccaccuccgucaccgccgucgucaccaacggccaccucaagauggccggcaugcacuucggcgccugcgacuacgaccgccuccccaacgaggucaccgucgccaagcccaacguccucaucgcccucaagauggucaagcgccaguccuacggcaccaacuccggcgucgccaucuaccaccgcuacaaggccggcaacuaccgcuccccccccaucaccgccgacaucgagcucgcccuccuccgcgccuga

SEQ ID NO: 568 - RNA, 660 nt, Artificial Sequence
  derived and/or modified CDS sequence (opt2) from MERS-CoV__AGV08590__M
auguccaacaugacccagcucaccgaggcccagaucaucgccaucaucaaggacuggaacuucgucuggucccucaucuuccuccucaucaccaucguccuccaguacggcuaccccucccgcuccaugaccgucuacgucuucaagauguucguccucuggcuccucuggcccuccuccauggcccucuccaucuucuccgccgucuaccccaucgaccucgccucccagaucaucuccggcaucgucgccgccgucuccgccaugauguggaucuccuacuucguccaguccauccgccucuucaugcgcaccggcuccuggugguccuucaaccccgagaccaacugccuccucaacguccccuucggcggcaccaccgucguccgcccccucgucgaggacuccaccuccgucaccgccgucgucaccaacggccaccucaagauggccggcaugcacuucggcgccugcgacuacgaccgccuccccaacgaggucaccgucgccaagcccaacguccucaucgcccucaagauggucaagcgccaguccuacggcaccaacuccggcgucgccaucuaccaccgcuacaaggccggcaacuaccgcuccccccccaucaccgccgacaucgagcucgcccuccuccgcgccuga

SEQ ID NO: 569 - RNA, 660 nt, Artificial Sequence
  derived and/or modified CDS sequence (opt2) from MERS-CoV__AHI48567__M
auguccaacaugacccagcucgccgaggcccagaucaucgccaucaucaaggacuggaacuucgccuggucccucaucuuccuccucaucaccaucguccuccaguacggcuaccccucccgcuccaugaccgucuacgucuucaagauguucguccucuggcuccucuggcccuccuccauggcccucuccaucuucuccgccgucuaccccaucgaccucgccucccagaucaucuccggcaucgucgccgccgucuccgccaugauguggaucuccuacuucguccaguccauccgccucuucaugcgcaccggcuccuggugguccuucaaccccgagaccaacugccuccucaacguccccuucggcggcaccaccgucguccgcccccucgucgaggacuccaccuccgucaccgccgucgucaccaacggccaccucaagauggccggcaugcacuucggcgccugcgacuacgaccgccuccccaacgaggucaccgucgccaagcccaacguccucaucgcccucaagauggucaagcgccaguccuacggcaccaacuccggcgucgccaucuaccaccgcuacaaggccggcaacuaccgcuccccccccaucaccgccgacaucgagcucgcccuccuccgcgccuga

SEQ ID NO: 570 - RNA, 660 nt, Artificial Sequence
  derived and/or modified CDS sequence (opt2) from MERS-CoV__AHI48589__M
auguccaacaugacccagcucaccgaggcccagaucaucgccgucaucaaggacuggaacuucgccuggucccucaucuuccuccucaucaccaucguccuccaguacggcuaccccucccgcuccaugaccgucuacgucuucaagauguucguccucuggcuccucuggcccuccuccauggcccucuccaucuucuccgccaucuaccccaucgaccucgccucccagaucaucuccggcaucgucgccgccgucuccgccaugauguggaucuccuacuucguccaguccauccgccucuucaugcgcaccggcuccuggugguccuucaaccccgagaccaacugccuccucaacguccccuucggcggcaccaccgucguccgcccccucgucgaggacuccaccuccgucaccgccgucgucaccaacggccaccucaagauggccggcaugcacuucggcgccugcgacuacgaccgccuccccaacgaggucaccgucgccaagcccaacguccucaucgcccucaagauggucaagcgccaguccuacggcaccaacuccggcgucgccaucuaccaccgcuacaaggccggcaacuaccgcuccccccccaucaccgccgacaucgagcucgcccuccuccgcgccuga

SEQ ID NO: 571 - RNA, 660 nt, Artificial Sequence
  derived and/or modified CDS sequence (opt2) from MERS-CoV__AIL23940__M
auguccaacaugacccagcucaccgaggcccagaucaucgccaucaucaaggacuggaacuucgccuggucccucaucuuccuccucaucaccaucguccuccaguacggcuaccccucccgcuccaugaccgucuacgucuucaagauguucguccucuggcuccucuggcccuccuccauggcccucuccaucuucuccgccaucuaccccaucgaccucgccucccagaucaucuccggcaucgucgccgccgucuccgccaugauguggaucuccuacuucguccaguccauccgccucuucaugcgcaccggcuccuggugguccuucaaccccgagaccaacugccuccucaacguccccuucggcggcaccaccgucguccgcccccucgucgaggacuccaccuccgucaccgccgucgucaccaacggccaccucaagauggccggcaugcacuucggcgccugcgacuacgaccgccuccccaacgaggucaccgucgccaagcccaacgucgucaucgcccucaagauggucaagcgccaguccuacggcaccaacuccggcgucgccaucuaccaccgcuacaaggccggcaacuaccgcuccccccccaucaccgccgacaucgagcucgcccuccuccgcgccuga

SEQ ID NO: 572 - RNA, 660 nt, Artificial Sequence
  derived and/or modified CDS sequence (opt2) from MERS-CoV__AKM76245__M
auguccaacaucacccagcucaccgaggcccagaucaucgccaucaucaaggacuggaacuucgccuggucccucaucuuccuccucaucaccaucguccuccaguacggcuaccccucccgcuccaugaccgucuacgucuucaagauguucguccucuggcuccucuggcccuccuccauggcccucuccaucuucuccgccgucuaccccaucgaccucgccucccagaucaucuccggcaucgucgccgccgucuccgccaugauguggaucuccuacuucguccaguccauccgccucuucaugcgcaccggcuccuggugguccuucaaccccgagaccaacugccuccucaacguccccuucggcggcaccaccgucguccgcccccucgucgaggacuccaccuccgucaccgccgucgucaccaacggccaccucaagauggccggcaugcacuucggcgccugcgacuacgaccgccuccccaacgaggucaccgucgccaagcccaacguccucaucgcccucaagauggucaagcgccaguccuacggcaccaacuccggcgucgccaucuaccaccgcuacaaggccggcaacuaccgcuccccccccaucaccgccgacaucgagcucgcccuccuccgcgccuga

SEQ ID NO: 573 - RNA, 660 nt, Artificial Sequence
  derived and/or modified CDS sequence (opt2) from MERS-CoV__ALW82726__M
auguccaacaugacccagcucaccgaggcccagaucaucgccaucaucaaggacuggcacuucgccuggucccucaucuuccuccucaucaccaucguccuccaguacggcuaccccucccgcuccaugaccgucuacgucuucaagauguucguccucuggcuccucuggcccuccuccauggcccucuccaucuucuccgccaucuaccccaucgaccucgccucccagaucaucuccggcaucgucgccgccgucuccgccaugauguggaucuccuacuucguccaguccauccgccucuucaugcgcaccggcuccuggugguccuucaaccccgagaccaacugccuccucaacguccccaucggcggcaccaccgucguccgcccccucgucgaggacuccaccuccgucaccgccgucgucaccaacggccaccucaagauggccggcaugcacuucggcgccugcgacuacgaccgccuccccaacgaggucaccgucgccaagcccaacguccucaucgcccucaagauggucaagcgccaguccuacggcaccaacuccggcgucgccaucuaccaccgcuacaaggccggcaacuaccgcuccccccccaucaccgccgacaucgagcucgcccuccuccgcgccuga

SEQ ID NO: 574 - RNA, 660 nt, Artificial Sequence
  derived and/or modified CDS sequence (opt2) from MERS-CoV__ALX27238__M
auguccaacaugacccagcucaccgaggcccagaucaucgccaucaucaaggacugguccuucgccuggucccucaucuuccuccucaucaccaucguccuccaguacggcuaccccucccgcuccaugaccgucuacgucuucaagauguucguccucuggcuccucuggcccuccuccauggcccucuccaucuucuccgccgucuaccccaucgaccucgccucccagaucaucuccggcaucgucgccgccgucuccgccaugauguggaucuccuacuucguccaguccauccgccucuucaugcgcaccggcuccuggugguccuucaaccccgagaccaacugccuccucaacguccccuucggcggcaccaccgucguccgcccccucgucgaggacuccaccuccgucaccgccgucgucaccaacggccaccucaagauggccggcaugcacuucggcgccugcgacuacgaccgccuccccaacgaggucaccgucgccaagcccaacguccucaucgcccucaagauggucaagcgccaguccuacggcaccaacuccggcgucgccaucuaccaccgcuacaaggccggcaacuaccgcuccccccccaucaccgccgacaucgagcucgcccuccuccgcgccuga

SEQ ID NO: 575 - RNA, 660 nt, Artificial Sequence
  derived and/or modified CDS sequence (opt2) from MERS-CoV__AMQ49021__M
auguccaacaugacccagcucaccgaggcccagaucaucgccaucaucaaggacuggcacuucgccuggucccucaucuuccuccucaucaccaucguccuccaguacggcuaccccucccgcuccaugaccgucuacgucuucaagauguucguccucuggcuccucuggcccuccuccauggcccucuccaucuucuccgccaucuaccccaucgaccucgccucccagaucaucuccggcaucgucgccgccgucuccgccaugauguggaucuccuacuucguccaguccauccgccucuucaugcgcaccggcuccuggugguccuucaaccccgagaccaacugccuccucaacguccccaucggcggcaccaccgucguccgcccccucgucgaggacuccaccuccgucaccgccgucgucaccaacggccaccucaagauggccggcaugcacuucggcgccugcgacuacgaccgccucuccaacgaggucaccgucgccaagcccaacguccucaucgcccucaagauggucaagcgccaguccuacggcaccaacuccggcgucgccaucuaccaccgcuacaaggccggcaacuaccgcuccccccccaucaccgccgacaucgagcucgcccuccuccgcgccuga

SEQ ID NO: 576 - RNA, 660 nt, Artificial Sequence
  derived and/or modified CDS sequence (opt2) from MERS-CoV__AJG44108__M
auguccaacaugacccagcucaccgaggcccagaucaucgccaucaucaaggacuggaacuucgccuggucccucaucuuccuccucaucaccaucguccuccaguacggcuaccccucccgcuccaugaccgucuacgucuucaagauguucguccucuggcuccucuggcccuccuccauggcccucuccaucuucuccgccuucuaccccaucgaccucgccucccagaucaucuccggcaucgucgccgccgucuccgccaugauguggaucuccuacuucguccaguccauccgccucuucaugcgcaccggcuccuggugguccuucaaccccgagaccaacugccuccucaacguccccuucggcggcaccaccgucguccgcccccucgucgaggacuccaccuccgucaccgccgucgucaccaacggccaccucaagauggccggcaugcacuucggcgccugcgacuacgaccgccuccccaacgaggucaccgucgccaagcccaacguccucaucgcccucaagauggucaagcgccaguccuacggcaccaacuccggcgucgccaucuaccaccgcuacaaggccggcaacuaccgcuccccccccaucaccgccgacaucgagcucgcccuccuccgcgccuga

SEQ ID NO: 577 - RNA, 660 nt, Artificial Sequence
  derived and/or modified CDS sequence (opt2) from MERS-CoV__ALA49369__M
auguccaacaugacccagcucaccgaggcccagaucaucgccaucaucaaggacuggaacuucgccuggucccucaucuuccuccucaucaccaucguccuccaguacggcuaccccucccgcuccaugaccgucuacgucuucaagauguucguccucuggcuccucuggcccuccuccauggcccucuccaucuucuccgccaucuaccccaucgaccucgccucccagaucaucuccggcaucgucgccgccgucuccgccaugauguggaucuccuacuucguccaguccauccgccucuucaugcgcaccggcuccuggugguccuucaaccccgagaccaacugccuccucaacguccccaucggcggcaccaccgucguccgcccccucgucgaggacuccaccuccgucaccgccgucgucaccaacggccaccucaagauggccggcaugcacuucggcgccugcgacuacgaccgccuccccaacgaggucaccgucgccaagcccaacguccucaucgcccucaagauggucaagcgccaguccuacggcaccaacuccggcgucgccaucuaccaccgcuacaaggccggcaacuaccgcuccccccccaucaccgccgacaucgagcucgcccuccuccgcgccuga

SEQ ID NO: 578 - RNA, 660 nt, Artificial Sequence
  derived and/or modified CDS sequence (opt2) from MERS-CoV__ALA49424__M
auguccaacaugacccagcucaccgaggcccagaucaucgccaucaucaaggacuggaacuucgccuggucccucaucuuccuccucaucaccaucguccuccaguacggcuaccccucccgcuccaugaccgucuacgucuucaagauguucguccucuggcuccucuggcccuccuccauggcccucuccaucuucuccgccaucuaccccaucgaccucgccucccagaucaucuccggcaucgucgccgccgucuccgccaugaugcgcaucuccuacuucguccaguccauccgccucuucaugcgcaccggcuccuggugguccuucaaccccgagaccaacugccuccucaacguccccuucggcggcaccaccgucguccgcccccucgucgaggacuccaccuccgucaccgccgucgucaccaacggccaccucaagauggccggcaugcacuucggcgccugcgacuacgaccgccuccccaacgaggucaccgucgccaagcccaacguccucaucgcccucaagauggucaagcgccaguccuacggcaccaacuccggcgucgccaucuaccaccgcuacaaggccggcaacuaccgcuccccccccaucaccgccgacaucgagcucgcccuccuccgcgccuga

SEQ ID NO: 579 - RNA, 660 nt, Artificial Sequence
  derived and/or modified CDS sequence (opt2) from MERS-CoV__ALA49908__M
auguccaacaugacccagcucaccgaggcccagaucaucgccaucaucaaggacuggaacuucgccuggucccucaucuuccuccucaucaccaucguccuccaguacggcuaccccucccgcuccaugaccgucuacgucuucaagauguucguccucuggcuccucuggcccuccuccauggcccucuccaucuucuccgccaucuaccccaucgaccucuccucccagaucaucuccggcaucgucgccgccgucuccgccaugauguggaucuccuacuucguccaguccauccgccucuucaugcgcaccggcuccuggugguccuucaaccccgagaccaacugccuccucaacguccccuucggcggcaccaccgucguccgcccccucgucgaggacuccaccuccgucaccgccgucgucaccaacggccaccucaagauggccggcaugcacuucggcgccugcgacuacgaccgccuccccaacgaggucaccgucgccaagcccaacguccucaucgcccucaagauggucaagcgccaguccuacggcaccaacuccggcgucgccaucuaccaccgcuacaaggccggcaacuaccgcuccccccccaucaccgccgacaucgagcucgcccuccuccgcgccuga

SEQ ID NO: 580 - RNA, 660 nt, Artificial Sequence
  derived and/or modified CDS sequence (opt2) from MERS-CoV__ALA49963__M
auguccaacaugacccagcucaccgaggcccagaucaucgccaucaucaaggacuggaacuucgccuggucccucaucuuccuccucaucaccaucguccuccaguacggcuaccccucccgcuccaugaccgucuacgucuucaagauguucguccucuggcuccucuggcccuccuccauggcccucuccaucuucuccgccaucuaccccaucgaccucgccucccagaucaucuccggcaucgucgccgccgucuccgccaugauguggaucuccuacuucguccaguccauccgccucuucaugcgcaccggcuccuggugguccuucaaccccgagaccaacugccuccucaacguccccaucggcggcaccaccgucguccgcccccucgucgaggacuccaccuccgucaccgccgucgucaccaacggccaccucaagauggccggcaugcacuucggcgccugcgacuacgaccgccucuccaacgaggucaccgucgccaagcccaacguccucaucgcccucaagauggucaagcgccaguccuacggcaccaacuccggcgucgccaucuaccaccgcuacaaggccggcaacuaccgcuccccccccaucaccgccgacaucgagcucgcccuccuccgcgccuga

SEQ ID NO: 581 - RNA, 1242 nt, Artificial Sequence
  derived and/or modified CDS sequence (opt2) from MERS-CoV__AFS88943__N
auggccucccccgccgccccccgcgccgucuccuucgccgacaacaacgacaucaccaacaccaaccucucccgcggccgcggccgcaaccccaagccccgcgccgcccccaacaacaccgucuccugguacaccggccucacccagcacggcaaggucccccucaccuucccccccggccagggcgucccccucaacgccaacuccacccccgcccagaacgccggcuacuggcgccgccaggaccgcaagaucaacaccggcaacggcaucaagcagcucgccccccgcugguacuucuacuacaccggcaccggccccgaggccgcccuccccuuccgcgccgucaaggacggcaucgucuggguccacgaggacggcgccaccgacgcccccuccaccuucggcacccgcaaccccaacaacgacuccgccaucgucacccaguucgcccccggcaccaagcuccccaagaacuuccacaucgagggcaccggcggcaacucccaguccuccucccgcgccuccucccucucccgcaacuccucccgcuccuccucccagggcucccgcuccggcaacuccacccgcggcaccucccccggccccuccggcaucggcgccgucggcggcgaccuccucuaccucgaccuccucaaccgccuccaggcccucgaguccggcaaggucaagcagucccagcccaaggucaucaccaagaaggacgccgccgccgccaagaacaagaugcgccacaagcgcaccuccaccaaguccuucaacaugguccaggccuucggccuccgcggccccggcgaccuccagggcaacuucggcgaccuccagcucaacaagcucggcaccgaggacccccgcuggccccagaucgccgagcucgcccccaccgccuccgccuucaugggcaugucccaguucaagcucacccaccagaacaacgacgaccacggcaaccccgucuacuuccuccgcuacuccggcgccaucaagcucgaccccaagaaccccaacuacaacaaguggcucgagcuccucgagcagaacaucgacgccuacaagaccuuccccaagaaggagaagaagcagaaggcccccaaggaggaguccaccgaccagauguccgagccccccaaggagcagcgcguccagggcuccaucacccagcgcacccgcacccgccccuccguccagcccggccccaugaucgacgucaacaccgacuga

SEQ ID NO: 582 - RNA, 1236 nt, Artificial Sequence
  derived and/or modified CDS sequence (opt2) from MERS-CoV__AFY13314__N
auggccucccccgccgccccccgcgccgucuccuucgccgacaacaacgacaucaccaacaccaaccucucccgcggccgcggccgcaaccccaagccccgcgccgcccccaacaacaccgucuccugguacaccggccucacccagcacggcaaggucccccucaccuucccccccggccagggcgucccccucaacgccaacuccacccccgcccagaacgccggcuacuggcgccgccaggaccgcaagaucaacaccggcaacggcaucaagcagcucgccccccgcugguacuucuacuacaccggcaccggccccgaggccgcccuccccuuccgcgccgucaaggacggcaucgucuggguccacgaggacggcgccaccgacgcccccuccaccuucggcacccgcaaccccaacaacgacuccgccaucgucacccaguucgcccccggcaccaagcuccccaagaacuuccacaucgagggcaccggcggcaacucccaguccuccucccgcgccuccuccgucucccgcaacuccucccgcuccuccucccagggcucccgcuccggcaacuccacccgcggcaccucccccggccccuccggcaucggcgccgucggcggcgaccuccucuaccucgaccuccucaaccgccuccaggcccucgaguccggcaaggucaagcagucccagcccaaggucaucaccaagaaggacgccgccgccgccaagaacaagaugcgccacaagcgcaccuccaccaaguccuucaacaugguccaggccuucggccuccgcggccccggcgaccuccagggcaacuucggcgaccuccagcucaacaagcucggcaccgaggacccccgcuggccccagaucgccgagcucgcccccaccgccuccgccuucaugggcaugucccaguucaagcucacccaccagaacaacgacgaccacggcaaccccgucuacuuccuccgcuacuccggcgccaucaagcucgaccccaagaaccccaacuacaacaaguggcucgagcuccucgagcagaacaucgacgccuacaagaccuuccccaagaaggagaagaagcagaaggcccccaaggaggaguccaccgaccagauguccgagccccccaaggagcaccgcguccagggcacccagcgcacccgcacccgccccuccguccagcccggccccaugaucgacgucaacaccgacuga

SEQ ID NO: 583 - RNA, 1242 nt, Artificial Sequence
  derived and/or modified CDS sequence (opt2) from MERS-CoV__AGH58724__N
auggccucccccgccgccccccgcgccgucuccuucgccuacaacaacgacaucaccaacaccaaccucucccgcggccgcggccgcaaccccaagccccgcgccgcccccaacaacaccgucuccugguacaccggccucacccagcacggcaaggucccccucaccuucccccccggccagggcgucccccucaacgccaacuccacccccgcccagaacgccggcuacuggcgccgccaggaccgcaagaucaacaccggcaacggcaucaagcagcucgccccccgcugguacuucuacuacaccggcaccggccccgaggccgcccuccccuuccgcgccgucaaggacggcaucgucuggguccacgaggacggcgccaccgacgcccccuccaccuucggcacccgcaaccccaacaacgacuccgccaucgucacccaguucgcccccggcaccaagcuccccaagaacuuccacaucgagggcaccggcggcaacucccaguccuccucccgcgccuccuccgucucccgcaacuccucccgcuccuccucccagggcucccgcuccggcaacuccacccgcggcaccucccccggccccuccggcaucggcgccgucggcggcgaccuccucuaccucgaccuccucaaccgccuccaggcccucgaguccggcaaggucaagcagucccagcccaaggucaucaccaagaaggacgccgccgccgccaagaacaagaugcgccacaagcgcaccuccaccaaguccuucaacaugguccaggccuucggccuccgcggccccggcgaccuccagggcaacuucggcgaccuccagcucaacaagcucggcaccgaggacccccgcuggccccagaucgccgagcucgcccccaccgccuccgccuucaugggcaugucccaguucaagcucacccaccagaacaacgacgaccacggcaaccccgucuacuuccuccgcuacuccggcgccaucaagcucgaccccaagaaccccaacuacaacaaguggcucgagcuccucgagcagaacaucgacgccuacaagaccuuccccaagaaggagaagaagcagaaggcccccaaggaggaguccaccgaccagauguccgagccccccaaggagcagcgcguccagggcuccaucacccagcgcacccgcacccgccccuccguccagcccggccccaugaucgacgucaacaccgacuga

SEQ ID NO: 584 - RNA, 1242 nt, Artificial Sequence
  derived and/or modified CDS sequence (opt2) from MERS-CoV__AGV08397__N
auggccucccccgccgccccccgcgccgucuccuucgccgacaacaacgacaucaccaacaccaaccucucccgcggccgcggccgcaaccccaagccccgcgccgcccccaacaacaccgucuccugguacaccggccucacccagcacggcaaggucccccucaccuucccccccggccagggcgucccccucaacgccaacuccacccccgcccagaacgccggcuacuggcgccgccaggaccgcaagaucaacaccggcaacggcaucaagcagcucgccccccgcugguacuucuacuacaccggcaccggccccgaggccgcccuccccuuccgcgccgucaaggacggcaucgucuggguccacgaggacggcgccaccgacgcccccuccaccuucggcacccgcaaccccaacaacgacuccgccaucgucacccaguucgcccccggcaccaagcuccccaagaacuuccacaucgagggcaccggcggcaacucccaguccuccucccgcgccuccuccgucucccgcaacuccucccgcuccuccucccagggcucccgcuccggcaacuccacccgcggcaccucccccggccccuccggcaucggcgccgucggcggcgaccuccucuaccucgaccuccucaaccgccuccaggcccucgaguccggcaaggucaagcagucccagcccaaggucaucaccaagaaggacgccgccgccgccaagaacaagaugcgccacaagcgcaccuccaccaaguccuucaacaugguccaggccuucggccuccgcggccccggcgaccuccagggcaacuucggcgaccuccagcucaacaagcucggcaccgaggacccccgcuggccccagaucgccgagcucgcccccaccgccuccgccuucaugggcaugucccaguucaagcucacccaccagaacaacgacgaccacggcaaccccgucuacuuccuccgcuacuccggcgccaucaagcucgaccccaagaaccccaacuacaacaaguggcucgagcuccucgagcagaacaucgacgccuacaagaccuuccccaagaaggagaagaagcagaaggcccccaaggaggagcucaccgaccagauguccgagccccccaaggagcagcgcguccagggcuccaucacccagcgcacccgcacccgccccuccguccagcccggccccaugaucgacgucaacaccgacuga

SEQ ID NO: 585 - RNA, 1242 nt, Artificial Sequence
  derived and/or modified CDS sequence (opt2) from MERS-CoV__AGV08415__N
auggccucccccgccgccccccgcgccgucuccuucgccgacaacaacgacaucaccaacaccaaccucucccgcggccgcggccgcaaccccaagccccgcgccgcccccaacaacaccgucuccugguacaccggccucacccagcacggcaaggucccccucaccuucccccccggccagggcgucccccucaacgccaacuccacccccgcccagaacgccggcuacuggcgccgccaggaccgcaagaucaacaccggcaacggcaucaagcagcucgccccccgcugguacuucuacuacaccggcaccggccccgaggccgcccuccccuuccgcgccgucaaggacggcaucgucuggguccacgaggacggcgccaccgacgcccccuccaccuucggcacccgcaaccccaacaacgacuccgccaucgucacccaguucgcccccggcaccaagcuccccaagaacuuccacaucgagggcaccggcggcaacucccaguccuccucccgcgccuccuccgucucccgcaacuccucccgcuccuccucccagggcucccgcuccggcaacuccacccgcggcaccucccccggccccuccggcaucggcgccgucggcggcgaccuccucuaccucgaccuccucaaccgccuccaggcccucgaguccggcaaggucaagcagucccagcccaaggucaucaccaagaaggacgccgccgccgccaagaacaagaugcgccacaagcgcaccuccaccaaguccuucaacaugguccaggccuucggccuccgcggccccggcgaccuccagggcaacuucggcgaccuccagcucaacaagcucggcaccgaggacccccgcuggccccagaucgccgagcucgcccccaccgccuccgccuucaugggcaugucccaguucaagcucacccaccagaacaacgacgaccacggcaaccccgucuacuuccuccgcuacuccggcgccaucaagcucgaccccaagaaccccaacuacaacaaguggcucgagcuccucgagcagaacaucgacgccuacaagaccuuccccaagaaggagaagaagcagaaggcccccaaggaggaguccaccgaccagauguccgagccccccaaggagcagcgcguccagggcuccaucacccagcgcacccgcacccgccccuccguccagcccggccccaugaucgacgucaacaccgacuga

SEQ ID NO: 586 - RNA, 1242 nt, Artificial Sequence
  derived and/or modified CDS sequence (opt2) from MERS-CoV__AGV08487__N
auggccucccccgccgccccccgcgccgucuccuucgccgacaacaacgacaucaccaacaccaaccucucccgcggccgcggccgcaaccccaagccccgcgccgcccccaacaacaccgucuccugguacaccggccucacccagcacggcaaggucccccucaccuucccccccggccagggcgucccccucaacgccaacuccacccccgcccagaacgccggcuacuggcgccgccaggaccgcaagaucaacaccggcaacggcaucaagcagcucgccccccgcugguacuucuacuacaccggcaccggccccgaggccgcccuccccuuccgcgccgucaaggacggcaucgucuggguccacgagcacggcgccaccgacgcccccuccaccuucggcacccgcaaccccaacaacgacuccgccaucgucacccaguucgcccccggcaccaagcuccccaagaacuuccacaucgagggcaccggcggcaacucccaguccuccucccgcgccuccuccgucucccgcaacuccucccgcuccuccucccagggcucccgcuccggcaacuccacccgcggcaccucccccggccccuccggcaucggcgccgucggcggcgaccuccucuaccucgaccuccucaaccgccuccaggcccucgaguccggcaaggucaagcagucccagcccaaggucaucaccaagaaggacgccgccgccgccaagaacaagaugcgccacaagcgcaccuccaccaaguccuucaacaugguccaggccuucggccuccgcggccccggcgaccuccagggcaacuucggcgaccuccagcucaacaagcucggcaccgaggacccccgcuggccccagaucgccgagcucgcccccaccgccuccgccuucaugggcaugucccaguucaagcucacccaccagaacaacgacgaccacggcaaccccgucuacuuccuccgcuacuccggcgccaucaagcucgaccccaagaaccccaacuacaacaaguggcucgagcuccucgagcagaacaucgacgccuacaagaccuuccccaagaaggagaagaagcagaaggcccccaaggaggaguccaccgaccagauguccgagccccccaaggagcagcgcguccagggcuccaucacccagcgcacccgcacccgccccuccguccagcccggccccaugaucgacgucaacaccgacuga

SEQ ID NO: 587 - RNA, 1242 nt, Artificial Sequence
  derived and/or modified CDS sequence (opt2) from MERS-CoV__AHC74095__N
auggccucccccgccgccccccgcgccgucuccuucgccgacaacaacgacaucaccaacaccaaccucucccgcggccgcggccgcaaccccaagccccgcgccgcccccaacaacaccgucuccugguacaccggccucacccagcacggcaaggucccccucaccuucccccccggccagggcgucccccucaacgccaacuccacccccgcccagaacgccggcuacuggcgccgccaggaccgcaagaucaacaccggcaacggcaucaagcagcucgccccccgcugguacuucuacuacaccggcaccggccccgaggccgcccuccccuuccgcgccgucaaggacggcaucgucuggguccacgaggacggcgccaccgacgcccccuccaccuucggcacccgcaaccccaacaacgaccucgccaucgucacccaguucgcccccggcaccaagcuccccaagaacuuccacaucgagggcaccggcggcaacucccaguccuccucccgcgccuccuccgucucccgcaacuccucccgcuccuccucccagggcucccgcuccggcaacuccacccgcggcaccucccccggccccuccggcaucggcgccgucggcggcgaccuccucuaccucgaccuccucaaccgccuccaggcccucgaguccggcaaggucaagcagucccagcccaaggucaucaccaagaaggacgccgccgccgccaagaacaagaugcgccacaagcgcaccuccaccaaguccuucaacaugguccaggccuucggccuccgcggccccggcgaccuccagggcaacuucggcgaccuccagcucaacaagcucggcaccgaggacccccgcuggccccagaucgccgagcucgcccccaccgccuccgccuucaugggcaugucccaguucaagcucacccaccagaacaacgacgaccacggcaaccccgucuacuuccuccgcuacuccggcgccaucaagcucgaccccaagaaccccaacuacaacaaguggcucgagcuccucgagcagaacaucgacgccuacaagaccuuccccaagaaggagaagaagcagaaggcccccaaggaggaguccaccgaccagauguccgagccccccaaggagcagcgcguccagggcuccaucacccagcgcacccgcacccgccccuccguccagcccggccccaugaucgacgucaacaccgacuga

SEQ ID NO: 588 - RNA, 1242 nt, Artificial Sequence
  derived and/or modified CDS sequence (opt2) from MERS-CoV__AHI48535__N
auggccucccccgccgccccccgcgccgucuccuucgccgacaacaacgacaucaccaacaccaaccucucccgcggccgcggccgcaaccccaagccccgcgccgcccccaacaacaccgucuccugguacaccggccucacccagcacggcaaggucccccucaccuucucccccggccagggcgucccccucaacgccaacuccacccccgcccagaacgccggcuacuggcgccgccaggaccgcaagaucaacaccggcaacggcaucaagcagcucgccccccgcugguacuucuacuacaccggcaccggccccgaggccgcccuccccuuccgcgccgucaaggacggcaucgucuggguccacgaggacggcgccaccgacgcccccuccaccuucggcacccgcaaccccaacaacgacuccgccaucgucacccaguucgcccccggcaccaagcuccccaagaacuuccacaucgagggcaccggcggcaacucccaguccuccucccgcgccuccuccgucucccgcaacuccucccgcuccuccucccagggcucccgcuccggcaacuccacccgcggcaccucccccggccccuccggcaucggcgccgucggcggcgaccuccucuaccucgaccuccucaaccgccuccaggcccucgaguccggcaaggucaagcagucccagcccaaggucaucaccaagaaggacgccgccgccgccaagaacaagaugcgccacaagcgcaccuccaccaaguccuucaacaugguccaggccuucggccuccgcggccccggcgaccuccagggcaacuucggcgaccuccagcucaacaagcucggcaccgaggacccccgcuggccccagaucgccgagcucgcccccaccgccuccgccuucaugggcaugucccaguucaagcucacccaccagaacaacgacgaccacggcaaccccgucuacuuccuccgcuacuccggcgccaucaagcucgaccccaagaaccccaacuacaacaaguggcucgagcuccucgagcagaacaucgacgccuacaagaccuuccccaagaaggagaagaagcagaaggcccccaaggaggaguccaccgaccaggucuccgagccccccaaggagcagcgcguccagggcaucaucacccagcgcacccgcacccgccccuccguccagcccggccccaugaucgacgucaacaccgacuga

SEQ ID NO: 589 - RNA, 1242 nt, Artificial Sequence
  derived and/or modified CDS sequence (opt2) from MERS-CoV__AIL23941__N
auggccucccucgccgccccccgcgccgucuccuucgccgacaacaacgacaucaccaacaccaaccucucccgcggccgcggccgcaaccccaagccccgcgccgcccccaacaacaccgucuccugguacaccggccucacccagcacggcaaggucccccucaccuucccccccggccagggcgucccccucaacgccaacuccacccccgcccagaacgccggcuacuggcgccgccaggaccgcaagaucaacaccggcaacggcaucaagcagcucgccccccgcugguacuucuacuacaccggcaccggccccgaggccgcccuccccuuccgcgccgucaaggacggcaucgucuggguccacgagcacggcgccaccgacgcccccuccaccuucggcacccgcaaccccaacaacgacuccgccaucgucacccaguucgcccccggcaccaagcuccccaagaacuuccacaucgagggcaccggcggcaacucccaguccuccucccgcgccuccuccgucucccgcaacuccucccgcuccuccucccagggcucccgcuccggcaacuccacccgcggcaccucccccggccccuccggcaucggcgccgucggcggcgaccuccucuaccucgaccuccucaaccgccuccaggcccucgaguccggcaaggucaagcagucccagcccaaggucaucaccaagaaggacgccgccgccgccaagaacaagaugcgccacaagcgcaccuccaccaaguccuucaacaugguccaggccuucggccuccgcggccccggcgaccuccagggcaacuucggcgaccuccagcucaacaagcucggcaccgaggacccccgcuggccccagaucgccgagcucgcccccaccgccuccgccuucaugggcaugucccaguucaagcucacccaccagaacaacgacgaccacggcaaccccgucuacuuccuccgcuacuccggcgccaucaagcucgaccccaagaaccccaacuacaacaaguggcucgagcuccucgagcagaacaucgacgccuacaagaccuuccccaagaaggagaagaagcagaaggcccccaaggaggaguccaccgaccagauguccgagccccccaaggagcagcgcguccagggcuccaucacccagcgcacccgcacccgccccuccguccagcccggccccaugaucgacgucaacaccgacuga

SEQ ID NO: 590 - RNA, 1242 nt, Artificial Sequence
  derived and/or modified CDS sequence (opt2) from MERS-CoV__AIL23996__N
auggccucccccgccgccccccgcgccgucuccuucgccgacaacaacgacaucaccaacaccaaccucucccgcggccgcggccgcaaccccaagccccgcgccgcccccaacaacaccgucuccugguacaccggccucacccagcacggcaaggucccccucaccuucccccccggccagggcgucccccucaacgccaacuccacccccgcccagaacgccggcuacuggcgccgccaggaccgcaagaucaacaccggcaacggcaucaagcagcucgccccccgcugguacuucuacuacaccggcaccggccccgaggccgcccuccccuuccgcgccgucaaggacggcaucgucuggguccacgaggacggcgccaccgacgcccccuccaccuucggcacccgcaaccccaacaacgaccucgccaucgucacccaguucgcccccggcaccaagcuccccaagaacuuccacaucgagggcaccggcggcaacucccaguccuccucccgcgccuccuccgucucccgcaacuccucccgcuccuccucccagggcucccgcuccggcaacuccacccgcggcaccucccccggccccuccggcaucggcgccgucggcggcgaccuccucuaccucgaccuccucaaccgccuccaggcccucgaguccggcaaggucaagcagucccagcccaaggucaucaccaagaaggacgccgccgccgccaagaacaagaugcgccacaagcgcaccuccaccaaguccuucaacaugguccaggccuucggccuccgcggccccggcgaccuccagggcaacuucggcgaccuccagcucaacaagcucggcaccgaggacccccgcuggccccagaucgccgagcucgcccccaccgccuccgccuucaugggcaugucccaguucaagcucacccaccagaacaacgacgaccacggcaaccccgucuacuuccuccgcuacuccggcgccaucaagcucgaccccaagaaccccaacuacaacaaguggcucgagcuccucgagcagaacaucgacgccuacaagaccuuccccaagaaggagaagaagcagaaggcccccaaggaggaguccaccgaccagauguccgagccccccaaggagcagcgcguccagggcuccaucacccagcacacccgcacccgccccuccguccagcccggccccaugaucgacgucaacaccgacuga

SEQ ID NO: 591 - RNA, 1242 nt, Artificial Sequence
  derived and/or modified CDS sequence (opt2) from MERS-CoV__AIY60565__N
auggccgcccccgccgccccccgcgccgucuccuucgccgacaacaacgacaucaccaacaccaaccucucccgcggccgcggccgcaaccccaagccccgcgccgcccccaacaacaccgucuccugguacaccggccucacccagcacggcaaggucccccucaccuucccccccggccagggcgucccccucaacgccaacuccacccccgcccagaacgccggcuacuggcgccgccaggaccgcaagaucaacaccggcaacggcaucaagcagcucgccccccgcugguacuucuacuacaccggcaccggccccgaggccgcccuccccuuccgcgccgucaaggacggcaucgucuggguccacgaggacggcgccaccgacgcccccuccaccuucggcacccgcaaccccaacaacgacuccgccaucgucacccaguucgcccccggcaccaagcuccccaagaacuuccacaucgagggcaccggcggcaacucccaguccuccucccgcgccuccuccgucucccgcaacuccucccgcuccuccucccagggcucccgcuccggcaacuccacccgcggcaccucccccguccccuccggcaucggcgccgucggcggcgaccuccucuaccucgaccuccucaaccgccuccaggcccucgaguccggcaaggucaagcagucccagcccaaggucaucaccaagaaggacgccgccgccgccaagaacaagaugcgccacaagcgcaccuccaccaaguccuucaacaugguccaggccuucggccuccgcggccccggcgaccuccagggcaacuucggcgaccuccagcucaacaagcucggcaccgaggacccccgcuggccccagaucgccgagcucgcccccaccgccuccgccuucaugggcaugucccaguucaagcucacccaccagaacaacgacgaccacggcaaccccgucuacuuccuccgcuacuccggcgccaucaagcucgaccccaagaaccccaacuacaacaaguggcucgagcuccucgagcagaacaucgacgccuacaagaccuuccccaagaaggagaagaagcagaaggcccccaaggaggaguccaccgaccagauguccgagccccccaaggagcagcgcguccagggcuccaucacccagcgcacccgcacccgccccuccguccagcccggccccaugaucgacgucaacaccgacuga

SEQ ID NO: 592 - RNA, 1242 nt, Artificial Sequence
  derived and/or modified CDS sequence (opt2) from MERS-CoV__AIZ74424__N
auggccgcccccgccgccccccgcgccgucuccuucgccgacaacaacgacaucaccaacaccaaccucucccgcggccgcggccgcaaccccaagccccgcgccgcccccaacaacaccgucuccugguacaccggccucacccagcacggcaaggucccccucaccuucccccccggccagggcgucccccucaacgccaacuccacccccgcccagaacgccggcuacuggcgccgccaggaccgcaagaucaacaccggcaacggcaucaagcagcucgccccccgcugguacuucuacuacaccggcaccggccccgaggccgcccuccccuuccgcgccgucaaggacggcaucgucuggguccacgaggacggcgccaccgacgcccccuccaccuucggcacccgcaaccccaacaacgacuccgccaucgucacccaguucgcccccggcaccaagcuccccaagaacuuccacaucgagggcaccggcggcaacucccaguccuccucccgcgccuccuccgucucccgcaacuccucccgcuccuccucccagggcucccgcuccggcaacuccacccgcggcaccucccccggccccuccggcaucggcgccgucggcggcgaccuccucuaccucgaccuccucaaccgccuccaggcccucgaguccggcaaggucaagcagucccagcccaaggucaucaccaagaaggacgccgccgccgccaagaacaagaugcgccacaagcgcaccuccaccaaguccuucaacaugguccaggccuucggccuccgcggccccggcgaccuccagggcaacuucggcgaccuccagcucaacaagcucggcaccgaggacccccgcuggccccagaucgccgagcucgcccccaccgccuccgccuucaugggcaugucccaguucaagcucacccaccagaacaacgacgaccacggcaaccccgucuacuuccuccgcuacuccggcgccaucaagcucgaccccaagaaccccaacuacaacaaguggcucgagcuccucgagcagaacaucgacgccuacaagaccuuccccaagaaggagaagaagcagaaggcccccaaggaggaguccaccgaccagauguccgagccccccaaggagcagcgcguccagggcuccaucacccagcgcacccgcacccgccccuccguccagcccggccccaugaucgacgucaacaccgacuga

SEQ ID NO: 593 - RNA, 1242 nt, Artificial Sequence; identical to SEQ ID NO: 592
  derived and/or modified CDS sequence (opt2) from MERS-CoV__AIZ74430__N

SEQ ID NO: 594 - RNA, 1242 nt, Artificial Sequence
  derived and/or modified CDS sequence (opt2) from MERS-CoV__AKI29291__N
auggccucccccgccgccccccgcgccgucuccuucgccgacaacaacgacaucaccaacaccaaccucucccgcggccgcggccgcaaccccaagccccgcgccgcccccaacaacaccgucuccugguacaccggccucacccagcacggcaaggucccccucaccuucccccccggccagggcgucccccucaacgccaacuccacccccgcccagaacgccggcuacuggcgccgccaggaccgcaagaucaacaccggcaacggcaucaagcagcucgccccccgcugguacuucuacuacaccggcaccggccccgaggccgcccuccccuuccgcgccgucaaggacggcaucgucuggguccacgaggacggcgccaccgacgcccccuccaccuucggcacccgcaaccccaacaacgacuccgccaucgucacccaguucgcccccggcaccaagcuccccaagaacuuccacaucgagggcaccggcggcaacucccaguccuccucccgcgccuccuccgucucccgcaacuccucccgcuccuccucccagggcucccgcuccggcaacuccacccgcggcaccucccccggccccuccggcaucggcgccgucggcggcgaccuccucuaccucgaccuccucaaccgccuccaggcccucgaguccggcaaggucaagcagucccagcccaaggucaucaccaagaaggacgccgccgccgccaagaacaagaugcgccacaagcgcaccuccaccaaguccuucaacaugguccaggccuucggccuccgcggccccggcgaccuccagggcaacuucggcgaccuccagcucaacaagcucggcaccgaggacccccgcuggccccagaucgccgagcucgcccccaccgccuccgccuucaugggcaugucccaguucaagcucacccaccagaacaacgacgaccacggcaaccccgucuacuuccuccgcuacuccggcgccaucaagcucgaccccaagaaccccaacuacaacaaguggcucgagcuccucgagcagaacaucgacgccuacaagaccuuccccaagaaggagaagaagcagaaggcccccaaggaggaguccaccgaccagauguccgagccccccaaggagcagcgcguccagggcuccaucacccagcgcauccgcacccgccccuccguccagcccggccccaugaucgacgucaacaccgacuga

SEQ ID NO: 595 - RNA, 1242 nt, Artificial Sequence
  derived and/or modified CDS sequence (opt2) from MERS-CoV__AKK52599__N
auggccucccccgccgcccccugcgccgucuccuucgccgacaacaacgacaucaccaacaccaaccucucccgcggccgcggccgcaaccccaagccccgcgccgcccccaacaacaccgucuccugguacaccggccucacccagcacggcaaggucccccucaccuucccccccggccagggcgucccccucaacgccaacuccacccccgcccagaacgccggcuacuggcgccgccaggaccgcaagaucaacaccggcaacggcaucaagcagcucgccccccgcugguacuucuacuacaccggcaccggccccgaggccgcccuccccuuccgcgccgucaaggacggcaucgucuggguccacgaggacggcgccaccgacgcccccuccaccuucggcacccgcaaccccaacaacgacuccgccaucgucacccaguucgcccccggcaccaagcuccccaagaacuuccacaucgagggcaccggcggcaacucccaguccuccucccgcgccuccuccgucucccgcaacuccucccgcuccuccucccagggcucccgcuccggcaacuccacccgcggcaccucccccggccccuccggcaucggcgccgucggcggcgaccuccucuaccucgaccuccucaaccgccuccaggcccucgaguccggcaaggucaagcagucccagcccaaggucaucaccaagaaggacgccgccgccgccaagaacaagaugcgccacaagcgcaccuccaccaaguccuucaacaugguccaggccuucggccuccgcggccccggcgaccuccagggcaacuucggcgaccuccagcucaacaagcucggcaccgaggacccccgcuggccccagaucgccgagcucgcccccaccgccuccgccuucaugggcaugucccaguucaagcucacccaccagaacaacgacgaccacggcaaccccgucuacuuccuccgcuacuccggcgccaucaagcucgaccccaagaaccccaacuacaacaaguggcucgagcuccucgagcagaacaucgacgccuacaagaccuuccccaagaaggagaagaagcagaaggcccccaaggaggaguccaccgaccagauguccgagccccccaaggagcagcgcguccagggcuccaucacccagcgcacccgcacccgccccuccguccagcccggccccaugaucgacgucaacaccgacuga

SEQ ID NO: 596 - RNA, 1242 nt, Artificial Sequence
  derived and/or modified CDS sequence (opt2) from MERS-CoV__AKN24774__N
auggccucccccgccgccccccgcgccgucuccuucgccgacaacaacgacaucaccaacaccaaccucucccgcggccgcggccgcaaccccaagccccgcgccgcccccaacaacaccgucuccugguacaccggccucacccagcacggcaaggucccccucaccuucccccccggccagggcgucccccucaacgccaacuccacccccgcccagaacgccggcuacuggcgccgccaggaccgcaagaucaacaccggcaacggcaucaagcagcucgccccccgcugguacuucuacuacaccggcaccggccccgaggccgcccuccccuuccgcgccgucaaggacggcaucgucuggguccacgaggacggcgccaccgacgcccccuccaccuucggcacccgcaaccccaacaacgaccucgccaucgucacccaguucgcccccggcaccaagcuccccaagaacuuccacaucgagggcaccggcggcaacucccaguccuccucccgcgccuccuccgucucccgcaacuccucccgcuccuccucccagggcucccgcuccggcaacuccacccgcggcaccucccccggccccuccggcaucggcgccgucggcggcgaccuccucuaccucgaccuccucaaccgccuccaggcccucgaguccggcaaggucaagcagucccagcccaaggucaucaccaagaaggacgccgccgccgccaagaacaagaugcgccacaagcgcaccuccaccaaguccuucaacaugguccaggccuucggccuccgcggccccggcgaccuccagggcaacuucggcgaccuccagcucaacaagcucggcaccgaggacccccgcuggccccagaucgccgagcucguccccaccgccuccgccuucaugggcaugucccaguucaagcucacccaccagaacaacgacgaccacggcaaccccgucuacuuccuccgcuacuccggcgccaucaagcucgaccccaagaaccccaacuacaacaaguggcucgagcuccucgagcagaacaucgacgccuacaagaccuuccccaagaaggagaagaagcagaaggcccccaaggaggaguccaccgaccagauguccgagccccccaaggagcagcgcguccagggcuccaucacccagcacacccgcacccgccccuccguccagcccggccccaugaucgacgucaacaccgacuga

SEQ ID NO: 597 - RNA, 1242 nt, Artificial Sequence
  derived and/or modified CDS sequence (opt2) from MERS-CoV__ALW82676__N
auggccucccccgccgccccccgcgccgucuccuucgccgacaacaacgacaccaccaacaccaaccucucccgcggccgcggccgcaaccccaagccccgcgccgcccccaacaacaccgucuccugguacaccggccucacccagcacggcaaggucccccucaccuucccccccggccagggcgucccccucaacgccaacuccacccccgcccagaacgccggcuacuggcgccgccaggaccgcaagaucaacaccggcaacggcaucaagcagcucgccccccgcugguacuucuacuacaccggcaccggccccgaggccgcccuccccuuccgcgccgucaaggacggcaucgucuggguccacgaggacggcgccaccgacgcccccuccaccuucggcacccgcaaccccaacaacgacuccgccaucgucacccaguucgcccccggcaccaagcuccccaagaacuuccacaucgagggcaccggcggcaacucccaguccuccucccgcgccuccuccgucucccgcaacuccucccgcuccuccucccagggcucccgcuccggcaacuccacccgcggcaccucccccggccccuccggcaucggcgccgucggcggcgaccuccucuaccucgaccuccucaaccgccuccaggcccucgaguccggcaaggucaagcagucccagcccaaggucaucaccaagaaggacgccgccgccgccaagaacaagaugcgccacaagcgcaccuccaccaaguccuucaacaugguccaggccuucggccuccgcggccccggcgaccuccagggcaacuucggcgaccuccagcucaacaagcucggcaccgaggacccccgcuggccccagaucgccgagcucgcccccaccgccuccgccuucaugggcaugucccaguucaagcucacccaccagaacaacgacgaccacggcaaccccgucuacuuccuccgcuacuccggcgccaucaagcucgaccccaagaaccccaacuacaacaaguggcucgagcuccucgagcagaacaucgacgccuacaagaccuuccccaagaaggagaagaagcagaaggcccccaaggaggaguccaccgaccagauguccgagccccccaaggagcagcgcguccagggcuccaucacccagcgcacccgcacccgccccuccguccagcccggccccaugaucgacgucaacaccgacuga

SEQ ID NO: 598 - RNA, 1242 nt, Artificial Sequence
  derived and/or modified CDS sequence (opt2) from MERS-CoV__AMQ49033__N
auggccucccccgccgccccccgcgccgucuucuucgccgacaacaacgacaucaccaacaccaaccucucccgcggccgcggccgcaaccccaagccccgcgccgcccccaacaacaccgucuccugguacaccggccucacccagcacggcaaggucccccucaccuucccccccggccagggcgucccccucaacgccaacuccacccccgcccagaacgccggcuacuggcgccgccaggaccgcaagaucaacaccggcaacggcaucaagcagcucgccccccgcugguacuucuacuacaccggcaccggccccgaggccgcccuccccuuccgcgccgucaaggacggcaucgucuggguccacgaggacggcgccaccgacgcccccuccaccuucggcacccgcaaccccaacaacgacuccgccaucgucacccaguucgcccccggcaccaagcuccccaagaacuuccacaucgagggcaccggcggcaacucccaguccuccucccgcgccuccuccgucucccgcaacuccucccgcuccuccucccagggcucccgcuccggcaacuccacccgcggcaccucccccggccccuccggcaucggcgccgucggcggcgaccuccucuaccucgaccuccucaaccgccuccaggcccucgaguccggcaaggucaagcagucccagcccaaggucaucaccaagaaggacgccgccgccgccaagaacaagaugcgccacaagcgcaccuccaccaaguccuucaacaugguccaggccuucggccuccgcggccccggcgaccuccagggcaacuucggcgaccuccaguucaacaagcucggcaccgaggacccccgcuggccccagaucgccgagcucgcccccaccgccuccgccuucaugggcaugucccaguucaagcucacccaccagaacaacgacgaccacggcaaccccgucuacuuccuccgcuacuccggcgccaucaagcucgaccccaagaaccccaacuacaacaaguggcucgagcuccucgagcagaacaucgacgccuacaagaccuuccccaagaaggagaagaagcagaaggcccccaaggaggaguccaccgaccagauguccgagccccccaaggagcagcgcguccagggcuccaucacccagcgcacccgcacccgccccuccguccagcccggccccaugaucgacgucaacaccgacuga

SEQ ID NO: 599 - RNA, 1242 nt, Artificial Sequence
  derived and/or modified CDS sequence (opt2) from MERS-CoV__AHL18098__N
auggccuccuccgccgccccccgcgccgucuccuucgccgacaacaacgacaucaccaacaccaaccucucccgcggccgcggccgcaaccccaagccccgcgccgcccccaacaacaccgucuccugguacaccggccucacccagcacggcaaggucccccucaccuucccccccggccagggcgucccccucaacgccaacuccacccccgcccagaacgccggcuacuggcgccgccaggaccgcaagaucaacaccggcaacggcaucaagcagcucgccccccgcugguacuucuacuacaccggcaccggccccgaggccgcccuccccuuccgcgccgucaaggacggcaucgucuggguccacgaggacggcgccaccgacgcccccuccaccuucggcacccgcaaccccaacaacgacuccgccaucgucacccaguucgcccccggcaccaagcuccccaagaacuuccacaucgagggcaccggcggcaacucccaguccuccucccgcgccuccuccgucucccgcaacuccucccgcuccuccucccagggcucccgcuccggcaacuccacccgcggcaccucccccggccccuccggcaucggcgccgucggcggcgaccuccucuaccucgaccuccucaaccgccuccaggcccucgaguccggcaaggucaagcagucccagcccaaggucaucaccaagaaggacgccgccgccgccaagaacaagaugcgccacaagcgcaccuccaccaaguccuucaacaugguccaggccuucggccuccgcggccccggcgaccuccagggcaacuucggcgaccuccagcucaacaagcucggcaccgaggacccccgcuggccccagaucgccgagcucgcccccaccgccuccgccuucaugggcaugucccaguucaagcucacccaccagaacaacgacgaccacggcaaccccgucuacuuccuccgcuacuccggcgccaucaagcucgaccccaagaaccccaacuacaacaaguggcucgagcuccucgagcagaacaucgacgccuacaagaccuuccccaagaaggagaacaagcagaaggcccccaaggaggaguccaccgaccagauguccgagccccccaaggagcagcgcguccagggcuccaucacccagcgcacccgcacccgccccuccguccagcccggccccaugaucgacgucaacaccgacuga

SEQ ID NO: 600 - RNA, 1242 nt, Artificial Sequence
  derived and/or modified CDS sequence (opt2) from MERS-CoV__AHX00738__N
auggccgcccccgccgccccccgcgccgucuccuucgccgacaacaacgacaucaccaacaccaacaugucccgcggccgcggccgcaaccccaagccccgcgccgcccccaacaacaccgucuccugguacaccggccucacccagcacggcaaggucccccucaccuucccccccggccagggcgucccccucaacgccaacuccacccccgcccagaacgccggcuacuggcgccgccaggaccgcaagaucaacaccggcaacggcaucaagcagcucgccccccgcugguacuucuacuacaccggcaccggccccgaggccgcccuccccuuccgcgccgucaaggacggcaucgucuggguccacgaggacggcgccaccgacgcccccuccaccuucggcacccgcaaccccaacaacgacuccgccaucgucacccaguucgcccccggcaccaagcuccccaagaacuuccacaucgagggcaccggcggcaacucccaguccuccucccgcgccuccuccgucucccgcaacuccucccgcuccuccucccagggcucccgcuccggcaacuccacccgcggcaccucccccggccccuccggcaucggcgccgucggcggcgaccuccucuaccucgaccuccucaaccgccuccaggcccucgaguccggcaaggucaagcagucccagcccaaggucaucaccaagaaggacgccgccgccgccaagaacaagaugcgccacaagcgcaccuccaccaaguccuucaacaugguccaggccuucggccuccgcggccccggcgaccuccagggcaacuucggcgaccuccagcucaacaagcucggcaccgaggacccccgcuggccccagaucgccgagcucgcccccaccgccuccgccuucaugggcaugucccaguucaagcucacccaccagaacaacgacgaccacggcaaccccgucuacuuccuccgcuacuccggcgccaucaagcucgaccccaagaaccccaacuacaacaaguggcucgagcuccucgagcagaacaucgacgccuacaagaccuuccccaagaaggagaagaagcagaaggcccccaaggaggaguccaccgaccagauguccgagccccccaaggagcagcgcguccagggcuccaucacccagcgcacccgcacccgccccuccguccagcccggccccaugaucgacgucaacaccgacuga

SEQ ID NO: 601 - RNA, 1242 nt, Artificial Sequence
  derived and/or modified CDS sequence (opt2) from MERS-CoV__AHY22561__N
auggccucccccgccgccccccgcgccgucuccuucgccgacaacaacgacaucaccaacaccaaccucucccgcggccgcggccgcaaccccaagccccgcgccgcccccaacaacaccgucuccugguacaccggccucacccagcacggcaaggucccccucaccuucccccccggccagggcgucccccucaacgccaacuccacccccgcccagaacgccggcuacuggcgccgccaggaccgcaagaucaacaccggcaacggcaucaagcagcucgccccccgcugguacuucuacuacaccggcaccggccccgaggccgcccuccccuuccgcgccgucaaggacggcaucgucuggguccacgaggacggcgccaccgacgcccccuccaccuucggcacccgcaaccccaacaacgacuccgccaucgucacccaguucgcccccggcaccaagcuccccaagaacuuccacaucgagggcaccggcggcaacucccaguccuccucccgcgccuccuccgucucccgcaacuccucccgcuccuccucccagggcucccgcuccggcaacuccacccgcggcaccucccccggccccuccggcaucggcgccgucggcggcgaccuccucuaccucgaccuccucaaccgccuccaggcccucgaguccggcaaggucaagcagucccagcccaaggucaucaccaagaaggacgccgccgccgccaagaacaagaugcgccacaagcgcaccuccaccaaguccuucaacaugguccaggccuucggccuccgcggccccggcgaccuccagggcaacuucggcgaccuccagcucaacaagcucggcaccgaggacccccgcuggccccagaucgccgagcucgcccccaccgccuccgccuucaugggcaugucccaguucaagcucacccaccagaacaacgacgaccacggcaaccccgucuacuuccuccgcuacuccggcgccaucaagcucgaccccaagaaccccaacuacaacaaguggcucgagcuccucgagcagaacaucgacgccuacaagaccuuccccaagaaggagaacaagcagaaggcccccaaggaggaguccaccgaccagauguccgagccccccaaggagcagcgcguccagggcuccaucacccagcgcacccgcacccgccccuccguccagcccggccccaugaucgacgucaacaccgacuga

SEQ ID NO: 602 - RNA, 1242 nt, Artificial Sequence
  derived and/or modified CDS sequence (opt2) from MERS-CoV__AHY22571__N
auggccgcccccgccgccccccgcgccgucuccuucgccgacaacaacgacaucaccaacaccaaccucucccgcggccgcggccgcaaccccaagccccgcgccgcccccaacaacaccgucuccugguacaccggccucacccagcacggcaaggucccccucaccuucccccccggccagggcgucccccucaacgccaacuccacccccgcccagaacgccggcuacuggcgccgccaggaccgcaagaucaacaccggcaacggcaucaagcagcucgccccccgcugguacuucuacuacaccggcaccggccccgaggccgcccuccccuuccgcgccgucaaggacggcaucgucuggguccacgaggacggcgccaccgacgcccccuccaccuucggcacccgcaaccccaacaacgacuccgccaucgucacccaguucgcccccggcaccaagcuccccaagaacuuccacaucgagggcaccggcggcaacucccaguccuccucccgcgccuccuccgucucccgcaacuccucccgcuccuccucccagggcucccgcucccgcaacuccacccgcggcaccucccccggccccuccggcaucggcgccgucggcggcgaccuccucuaccucgaccuccucaaccgccuccaggcccucgaguccggcaaggucaagcagucccagcccaaggucaucaccaagaaggacgccgccgccgccaagaacaagaugcgccacaagcgcaccuccaccaaguccuucaacaugguccaggccuucggccuccgcggccccggcgaccuccagggcaacuucggcgaccuccagcucaacaagcucggcaccgaggacccccgcuggccccagaucgccgagcucgcccccaccgccuccgccuucaugggcaugucccaguucaagcucacccaccagaacaacgacgaccacggcaaccccgucuacuuccuccgcuacuccggcgccaucaagcucgaccccaagaaccccaacuacaacaaguggcucgagcuccucgagcagaacaucgacgccuacaagaccuuccccaagaaggagaacaagcagaaggcccccaaggaggaguccaccgaccagauguccgagccccccaaggagcagcgcguccagggcuccaucacccagcgcacccgcacccgccccuccguccagcccggccccaugaucgacgucaacaccgacuga

SEQ ID NO: 603 - RNA, 1242 nt, Artificial Sequence
  derived and/or modified CDS sequence (opt2) from MERS-CoV__ALA49381__N
auggccucccccgccgccccccgcgccgucuccuucgccgacaacaacgacaucaccaacaccaaccucucccgcggccgcggccgcaaccccaagccccgcgccgcccccaacaacaccgucuccugguacaccggccucacccagcacggcaaggucccccucaccuucccccccggccagggcgucccccucaacgccaacuccacccccgcccagaacgccggcuacuggcgccgccaggaccgcaagaucaacaccggcaacggcaucaagcagcucgccccccgcugguacuucuacuacaccggcaccggccccgaggccgcccuccccuuccgcgccgucaaggacggcaucgucuggguccacgaggacggcgccaccgacgcccccuccaccuucggcacccgcaaccccaacaacgacuccgccaucgucacccaguucgcccccggcaccaagcuccccaagaacuuccacaucgagggcaccggcggcaacucccaguccuccucccgcgccuccuccgucucccgcaacuccucccgcuccuccucccagggcucccgcuccggcaacuccacccgcggcuccucccccggccccuccggcaucggcgccgucggcggcgaccuccucuaccucgaccuccucaaccgccuccaggcccucgaguccggcaaggucaagcagucccagcccaaggucaucaccaagaaggacgccgccgccgccaagaacaagaugcgccacaagcgcaccuccaccaaguccuucaacaugguccaggccuucggccuccgcggccccggcgaccuccagggcaacuucggcgaccuccagcucaacaagcucggcaccgaggacccccgcuggccccagaucgccgagcucgcccccaccgccuccgccuucaugggcaugucccaguucaagcucacccaccagaacaacgacgaccacggcaaccccgucuacuuccuccgcuacuccggcgccaucaagcucgaccccaagaaccccaacuacaacaaguggcucgagcuccucgagcagaacaucgacgccuacaagaccuuccccaagaaggagaagaagcagaaggcccccaaggaggaguccaccgaccagauguccgagccccccaaggagcagcgcguccagggcuccaucacccagcgcacccgcacccgccccuccguccagcccggccccaugaucgacgucaacaccgacuga

SEQ ID NO: 604 - RNA, 1242 nt, Artificial Sequence
  derived and/or modified CDS sequence (opt2) from MERS-CoV__ALA49392__N
auggccucccccgccgccccccgcgccgucuccuucgccgacaacaacgacaucaccaacaccaaccucucccgcggccgcggccgcaaccccaagccccgcgccgcccccaacaacaccgucuccugguacaccggccucacccagcacggcaaggucccccucaccuucccccccggccagggcgucccccucaacgccaacuccacccccgcccagaacgccggcuacuggcgccgccaggaccgcaagaucaacaccggcaacggcaucaagcagcucgccccccgcugguacuucuacuacaccggcaccggccccgaggccgcccuccccuuccgcgccgucaaggacggcaucgucuggguccacgaggacggcgccaccgacgcccccuccaccuucggcacccgcaaccccaacaacgacuccgccaucgucacccaguucgcccccggcaccaagcuccccaagaacuuccacaucgagggcaccggcggcaacucccaguccuccucccgcgccuccuccgucucccgcaacuccucccgcuccuccucccagggcucccgcuccggcaacuccacccgcggcuccucccccggccccuccggcaucggcgccgucggcggcgaccuccucuaccucgaccuccucaaccgccuccaggcccucgaguccggcaaggucaagcagucccagcccaaggucaucaccaagaaggacgccgccgccgccaagaacaagaugcgccacaagcgcaccuccaccaaguccuucaacaugguccaggccuucggccuccgcggccccggcgaccuccagggcaacuucggcgaccuccagcucaacaagcucggcaccgaggacccccgcuggccccagaucgccgagcucgcccccaccgccuccgccuucaugggcaugucccaguucaagcucacccaccagaacaacgacgaccacggcaaccccgucuacuuccuccgcuacuccggcgccaucaagcucgaccccaagaaccccaacuacaacaaguggcucgagcuccucgagcagaacaucgacgccuacaagaccuuccccaagaaggagaagaagcagaaggcccccaaggaggaguccaccgaccagauguccgagccccccaaggagcagcgcguccgcggcuccaucacccagcgcacccgcacccgccccuccguccagcccggccccaugaucgacgucaacaccgacuga

SEQ ID NO: 605 - RNA, 1242 nt, Artificial Sequence
  derived and/or modified CDS sequence (opt2) from MERS-CoV__ALA49601__N
auggccucccccgccgccccccgcgccgucuccuucgccgacaacaacgacaucaccaacaccaaccucucccgcggccgcggccgcaaccccaagccccgcgccgcccccaacaacaccgucuccugguacaccggccucacccagcacggcaaggucccccucaccuucccccccggccagggcgucccccucaacgccaacuccacccccgcccagaacgccggcuacuggcgccgccaggaccgcaagaucaacaccggcaacggcaucaagcagcucgccccccgcugguacuucuacuacaccggcaccggccccgaggccgcccuccccuuccgcgccgucaaggacggcaucgucuggguccacgaggacggcgccaccgacgcccccuccaccuucggcacccgcaaccccaacaacgacuccgccaucgucacccaguucgcccccggcaccaagcuccccaagaacuuccacaucgagggcaccggcggcaacucccaguccuccucccgcgccuccuccgucucccgcaacuccucccgcuccuccucccagggcucccgcuccggcaacuccacccgcggcaccucccccggccucuccggcaucggcgccgucggcggcgaccuccucuaccucgaccuccucaaccgccuccaggcccucgaguccggcaaggucaagcagucccagcccaaggucaucaccaagaaggacgccgccgccgccaagaacaagaugcgccacaagcgcaccuccaccaaguccuucaacaugguccaggccuucggccuccgcggccccggcgaccuccagggcaacuucggcgaccuccagcucaacaagcucggcaccgaggacccccgcuggccccagaucgccgagcucgcccccaccgccuccgccuucaugggcaugucccaguucaagcucacccaccagaacaacgacgaccacggcaaccccgucuacuuccuccgcuacuccggcgccaucaagcucgaccccaagaaccccaacuacaacaaguggcucgagcuccucgagcagaacaucgacgccuacaagaccuuccccaagaaggagaagaagcagaaggcccccaaggaggaguccaccgaccagauguccgagccccccaaggagcagcgcguccagggcuccaucacccagcgcacccgcacccgccccuccguccagcccggccccaugaucgacgucaacaccgacuga

SEQ ID NO: 606 - RNA, 1242 nt, Artificial Sequence
  derived and/or modified CDS sequence (opt2) from MERS-CoV__ALA49843__N
auggccucccccgccgccccccgcgccgucuccuucgccgacaacaacgacaucaccaacaccaaccucucccgcggccgcggccgcaaccccaagccccgcgccgcccccaacaacaccgucuccugguacaccggccucacccagcacggcaaggucccccucaccuucccccccggccagggcgucccccucaacgccaacuccacccccgcccagaacgccggcuacuggcgccgccaggaccgcaagaucaacaccggcaacggcaucaagcagcucgccccccgcugguacuucuacuacaccggcaccggccccgaggccgcccuccccuuccgcgccgucaaggacggcaucgucuggguccacgaggacggcgccaccgacgcccccuccaccuucggcacccgcaaccccaacaacgacuccgccaucgucacccaguucgcccccggcaccaagcuccccaagaacuuccacaucgagggcaccggcggcaacucccaguccuccucccgcgccuccuccgucucccgcaacuccucccgcuccuccucccagggcucccgcuccggcaacuccacccgcugcaccucccccggccccuccggcaucggcgccgucggcggcgaccuccucuaccucgaccuccucaaccgccuccaggcccucgaguccggcaaggucaagcagucccagcccaaggucaucaccaagaaggacgccgccgccgccaagaacaagaugcgccacaagcgcaccuccaccaaguccuucaacaugguccaggccuucggccuccgcggccccggcgaccuccagggcaacuucggcgaccuccagcucaacaagcucggcaccgaggacccccgcuggccccagaucgccgagcucgcccccaccgccuccgccuucaugggcaugucccaguucaagcucacccaccagaacaacgacgaccacggcaaccccgucuacuuccuccgcuacuccggcgccaucaagcucgaccccaagaaccccaacuacaacaaguggcucgagcuccucgagcagaacaucgacgccuacaagaccuuccccaagaaggagaagaagcagaaggcccccaaggaggaguccaccgaccagauguccgagccccccaaggagcagcgcguccagggcuccaucacccagcgcacccgcacccgccccuccguccagcccggccccaugaucgacgucaacaccgacuga

SEQ ID NO: 607 - RNA, 1242 nt, Artificial Sequence
  derived and/or modified CDS sequence (opt2) from MERS-CoV__ALA49865__N
auggccucccccgccgccccccgcgccgucuccuucgccgacaacaacgacaucaccaacaccaaccucucccgcggccgcggccgcaaccccaagccccgcgccgcccccaacaacaccgucuccugguacaccggccucacccagcacggcaaggucccccucaccuucccccccggccagggcgucccccucaacgccaacuccacccccgcccagaacgccggcuacuggcgccgccaggaccgcaagaucaacaccggcaacggcaucaagcagcucgccccccgcugguacuucuacuacaucggcaccggccccgaggccgcccuccccuuccgcgccgucaaggacggcaucgucuggguccacgaggacggcgccaccgacgcccccuccaccuucggcacccgcaaccccaacaacgacuccgccaucgucacccaguucgcccccggcaccaagcuccccaagaacuuccacaucgagggcaccggcggcaacucccaguccuccucccgcgccuccuccgucucccgcaacuccucccgcuccuccucccagggcucccgcuccggcaacuccacccgcggcaccucccccggccccuccggcaucggcgccgucggcggcgaccuccucuaccucgaccuccucaaccgccuccaggcccucgaguccggcaaggucaagcagucccagcccaaggucaucaccaagaaggacgccgccgccgccaagaacaagaugcgccacaagcgcaccuccaccaaguccuucaacaugguccaggccuucggccuccgcggccccggcgaccuccagggcaacuucggcgaccuccagcucaacaagcucggcaccgaggacccccgcuggccccagaucgccgagcucgcccccaccgccuccgccuucaugggcaugucccaguucaagcucacccaccagaacaacgacgaccacggcaaccccgucuacuuccuccgcuacuccggcgccaucaagcucgaccccaagaaccccaacuacaacaaguggcucgagcuccucgagcagaacaucgacgccuacaagaccuuccccaagaaggagaagaagcagaaggcccccaaggaggaguccaccgaccagauguccgagccccccaaggagcagcgcguccagggcuccaucacccagcgcacccgcacccgccccuccguccagcccggccccaugaucgacgucaacaccgacuga

SEQ ID NO: 608 - RNA, 1242 nt, Artificial Sequence
  derived and/or modified CDS sequence (opt2) from MERS-CoV__ALA49909__N
auggccucccccgccgccccccgcgccgucuccuucgccgacaacaacgacaucaccaacaccaaccucucccgcggccgcggccgcaaccccaagccccgcgccgcccccaacaacaccgucuccugguacaccggccucacccagcacggcaaggucccccucaccuucccccccggccagggcgucccccucaacgccaacuccacccccgcccagaacgccggcuacuggcgccgccaggaccgcaagaucaacaccggcaacggcaucaagcagcucgccccccgcugguacuucuacuacaccggcaccggccccgaggccgcccuccccuuccgcgccgucaaggacggcaucgucuggguccacgagcacggcgccaccgacgcccccuccaccuucggcacccgcaaccccaacaacgacuccgccaucgucacccaguucgcccccggcaccaagcuccccaagaacuuccacaucgagggcaccggcggcaacucccaguccuccucccgcgccuccuccgucucccgcaacuccucccgcuccuccucccagggcucccgcuccggcaacuccacccgcugcaccucccccggccccuccggcaucggcgccgucggcggcgaccuccucuaccucgaccuccucaaccgccuccaggcccucgaguccggcaaggucaagcagucccagcccaaggucaucaccaagaaggacgccgccgccgccaagaacaagaugcgccacaagcgcaccuccaccaaguccuucaacaugguccaggccuucggccuccgcggccccggcgaccuccagggcaacuucggcgaccuccagcucaacaagcucggcaccgaggacccccgcuggccccagaucgccgagcucgcccccaccgccuccgccuucaugggcaugucccaguucaagcucacccaccagaacaacgacgaccacggcaaccccgucuacuuccuccgcuacuccggcgccaucaagcucgaccccaagaaccccaacuacaacaaguggcucgagcuccucgagcagaacaucgacgccuacaagaccuuccccaagaaggagaagaagcagaaggcccccaaggaggaguccaccgaccagauguccgagccccccaaggagcagcgcguccagggcuccaucacccagcgcacccgcacccgccccuccguccagcccggccccaugaucgacgucaacaccgacuga

SEQ ID NO: 609 - RNA, 4062 nt, Artificial Sequence
  derived and/or modified CDS sequence (opt3) from MERS-CoV__AFS88936__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaguucgcgaaugauacaaaaaucgcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaagacacaugcaacgcuguuuggcuccguggccugugaacacaucucuagcaccaugucccaguacucacggagcacucgaaguaugcucaaacgcagagacucuacauauggaccccugcagaccccugucggcugcguucuugggcugguaaauuccagcuuguucguggaggauuguaagcucccacugggacaaucguuaugcgcucugcccgacacaccuucaacucuaaccccaaggucugugcggaguguccccggugaaaugcgccucgccuccaucgcauuuaaccacccgauucagguggaucagcugaauagcucuuacuucaaacuuagcauaccuacgaacuuuuccuucggcguuacccaagaguauauccagacaacuauucagaaggugaccgucgacuguaaacaguacgugugcaauggguuccaaaagugcgaacaguugcugagagaguauggacaguuuuguucaaagaucaaccaggcgcuccauggcgcuaaucugaggcaagaugacaguguucguaacuuauucgccagcgugaaaucuucccagucaaguccaauuauccccgguuuugggggcgacuucaaucugacacuuuuggagccuguaagcauauccacuggaucucggucggcacgaagcgccaucgaagaucuccuguuugacaaggucaccauugcugaucccggcuacaugcagggguacgacgauugcaugcagcaaggaccagccucagcaagagaccuaaucugugcucaguauguggccggcuacaaagugcugccuccccucauggaugucaacauggaggcggccuauacguccagucugcuugguucuauugcugggguuggauggacagcaggcuugagcuccuucgccgcuaucccauuugcccagucaauauucuacaggcugaauggugugggcauuacccaacagguauuaucugaaaaccagaagcucaucgcaaauaaauuuaaccaggcgcugggggccaugcaaacuggauucacaaccacuaaugaggcuuuucagaaggugcaggacgccgucaacaacaaugcacaggcucuuagcaagcuggccagugaauuguccaacaccuucggcgcaauuagcgccucuaucggggauauaauccaacgccucgacgugcuggagcaggaugcucagauugaccggcuaaucaauggaagacugacaacgcucaacgcguucguugcccagcaacuggugaggucagaguccgcagcucuuagugcccaguuggccaaagauaaggucaaugaaugcgugaaagcucagagcaagcgcucgggcuuuuguggucaggggacccacauuguuucuuucguggucaacgcaccgaauggacuguauuuuaugcauguaggcuacuauccuuccaaccacaucgaggugguuagcgccuacgguuuaugcgacgcggcuaaucccacuaacuguauagccccagugaauggcuacuucauuaaaacaaacaauacccgaaucgucgacgaauggucauauacagggaguucuuuuuacgcacccgagccuaucacuucccucaacaccaaguauguggccccacaaguaacguaccagaauauuagcacaaaccugcccccuccgcuucugggaaacucaaccggcaucgauuuccaggacgagcuagaugaauuuuucaagaaugugaguacuagcauuccaaacuuugggucccucacccaaauaaauacaacucuguuggaccugaccuaugagauguuaucucuccagcaggucguuaaagcucugaacgaaagcuacaucgaucuuaaggagcugggaaauuauacauacuacaacaaauggcccugguauauuugguugggcuucaucgcaggucucguggcccuggcgcuaugcguguuuuucauucuguguugcacgggguguggaaccaauugcaugggcaaacuuaagugcaaccgguguugcgaccguuacgaagaguaugaucucgagccucauaagguccacgugcacuga

SEQ ID NO: 610 - RNA, 4062 nt, Artificial Sequence
  derived and/or modified CDS sequence (opt3) from MERS-CoV__AFY13307__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagauuucuuuccgaugacaggaccgaaguuccccagcuggugaacgcaaaucaauauaguccaugugucagcauugugcccucuacugucugggaggacggcgauuacuaccggaaacaguuguccccucucgaaggugggggcuggcugguggccucaggaaguacgguugcuaugacagagcaguuacagaugggcuucgggauaaccgugcaauauggaacugacaccaacagcguaugcccaaagcuggaauuugcgaaugauacaaaaaucgcaucgcagcuagguaacugugucgaguacucccucuauggcgugucugggcguggaguuuuccagaauugcaccgccgugggcguccgccagcaaagauuuguguacgacgcuuaucagaaccugguagguuacuauagcgaugacgggaacuacuacugucuuagggccugcgugucaguuccggucagugugauuuaugauaaggagacuaagacacaugcaacguuguucggcuccguggccugugaacacaucucuagcaccaugucccaguacucacggagcacucgaaguaugcugaaacgcagagacucuacauauggaccccuccagaccccugucggcugcguucuggggcuuguaaauuccagccuguuuguggaggauuguaaguugccacucggacaaucgcugugcgcuuuacccgacacaccuucaacucugaccccaaggucugugcggaguguccccggugaaaugcgccuagccuccaucgcauucaaccacccgauucagguggaucagcucaauagcucuuacuuuaaacugagcauaccuacgaacuucuccuucggcguuacccaagaguauauccagacaacuauucagaaggugaccgucgacuguaaacaguacgugugcaauggguuucaaaagugcgaacagcuuuugagagaguauggacaguucuguucaaagaucaaccaggcgcugcauggcgcuaaucucaggcaagaugacaguguucguaaccuguuugccagcgugaaaucuucccagucaaguccaauuauccccgguuucgggggcgacuuuaauuuaacacugcuugagccuguaagcauauccacuggaucucggucggcacgaagcgccaucgaagaucuccucuucgacaaggucaccauugcugaucccggcuacaugcagggguacgacgauugcaugcagcaaggaccagccucagcaagagaccugaucugugcucaguauguggccggcuacaaagugcuaccuccccugauggaugucaacauggaggcggccuauacguccagucuccuggguucuauugcugggguuggauggacagcaggccuuagcuccuuugccgcuaucccauucgcccagucaauauuuuacagguugaauggugugggcauuacccaacagguacugucugaaaaccagaaguuaaucgcaaauaaauucaaccaggcgcucggggccaugcaaacuggauuuacaaccacuaaugaggcuuuccacaaggugcaggacgccgucaacaacaaugcacaggcucugagcaaacuugccagugaacuguccaacaccuucggcgcaauuagcgccucuaucggggauauaauccagcgcuuggacgugcucgagcaagaugcucagauugaccggcugaucaauggaagacuaacaacgcugaacgcguuuguugcccagcagcucgugaggucagaguccgcagcucugagugcccaacuugccaaggauaaggucaaugaaugcgugaaagcucagagcaagcgcucgggcuucuguggucaggggacccauauuguuucuuuuguggucaacgcaccgaauggauuguauuucaugcacguaggcuacuauccuuccaaccauaucgaggugguuagcgccuacggucugugcgacgcggcuaaucccacuaacuguauagccccagugaauggcuacuuuauuaaaacaaacaauacccgaaucgucgacgaauggucauauacagggaguucuuucuacgcacccgagccuaucacuuccuuaaacaccaaguauguggccccacagguaacguaccaaaauauuagcacaaacuugcccccuccgcugcuuggaaacucaaccggcaucgauuuucaggacgagcuggaugaguucuuuaagaaugugaguacuagcauuccaaacuucgggucccuaacccagauaaauacaacucuccuggacuugaccuaugaaaugcugucuuuacaacaggucguuaaagcucucaacgaaagcuacaucgaucugaaggagcuuggaaauuauacauacuacaacaaauggcccugguauauuuggcugggcuuuaucgcagguuugguggcccucgcgcugugcguguucuuuauucuauguugcacgggguguggaaccaauugcaugggcaagcugaaaugcaaccgguguugcgaccguuacgaagaguaugaucuugagccucacaagguccacgugcauuga

SEQ ID NO: 611 - RNA, 4062 nt, Artificial Sequence
  derived and/or modified CDS sequence (opt3) from MERS-CoV__AGH58717__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccgugacaaccccacaaaaauuauuuguugcgaauuauucucaggacgugaagcaguucgcuaacggcuuugucgugcggauaggugccgcagccaauucgacugggacaguaaucauuucacccagcaccagugcuacgauccgcaaaauuuacccugcauucaugcugggauccucuguuggcaacuuuagcgauggcaagauggggcgauucuuuaaucauacucuagugcuccugccagacggaugugguacccuucugcgugccuucuacugcaucuuggagcccagauccggcaacuauuguccugcuggcaauucauacacaaguuuugccacuuaucacaccccagcgacagauugcagcgacggaaacuacaauaggaacgcaucucucaauuccuucaaggaauauuucaaccugcggaauuguaccuuuauguacacguauaacauaacugaggaugaaauucuggagugguucggcaucacacagaccgcccaagguguccaucucuuuucaagccgcuacguggacuuauacgggggaaauauguuccaguuugcuacucugccgguguaugacacaauuaaauacuauaguaucaucccccacucuauucuuuccauacagagcgauagaaaggccugggcagcuuucuacgucuauaaauugcagccucugaccuuucuacucgacuucucgguugauggcuacaucaggcgggccauugacugcggcuuuaacgaucugucucaacuucacuguuccuaugagucauucgacguggaaagugggguauacagcguguccucuuuugaggcgaagccaagcggaucagucguggaacaggccgaggguguugagugcgauuucaguccccuguuguccggcacgccuccacagguguacaacuuuaaacgccucgucuucaccaauuguaacuauaaucugacaaaguuacugagccucuucucugugaacgacuuuacuugcucacaaaucagucccgcagcuauagccagcaauuguuacuccucucuuauucuggauuauuucucguacccguugagcaugaaguccgaccuaucaguaaguucugcugggccuaucagccaguuuaacuauaaacaguccuucucaaauccaaccugccugauccucgccacaguuccccauaaccugacuaccauuacaaagccucuuaaauacagcuauaucaauaagugcucucgacuguuguccgaugacagaaccgaagugccccagcucgucaacgcaaaucaauacaguccaugugugagcauuguccccucuacugugugggaggacggagauuacuauaggaaacagcuguccccuuuagaaggcgguggguggcugguugccucaggcaguacgguggcuaugacagagcagcuacagaugggauuuggcauaaccguacaauacgggacugacaccaacagcgucugcccaaagcucgaguucgcgaaugauacaaaaaucgcaucgcagcugggaaacuguguggaauauucccuuuacgguguuucuggccgugggguguuucagaauugcaccgccgucggagugcggcagcaacgcuucguauaugacgcuuaccagaacuuggugggcuauuacagcgaugacgguaacuacuauugucugagagccugcguuucagucccggugagugugauuuacgauaaggagacuaagacacacgcaacgcucuuuggguccgucgccugugaacauaucucuagcaccaugucccaguauucaaggagcacucggaguaugcugaaacgacgcgacucuacauacggcccccuucagaccccuguuggaugcgugcugggcuugguaaauuccagccucuucguggaggauuguaagcugccauuagggcaaucgcugugcgcucuacccgacacaccuucaacucucaccccaagaucugucaggagugugcccggagaaaugcggcuggccuccaucgcauuuaaccacccgauucagguugaucagcuuaauagcucuuauuucaaauugagcauaccuacgaacuuuuccuucggugugacccaagaguacauccagacaacuauucagaaggucaccguggacuguaaacaguauguuugcaauggcuuccaaaagugcgaacagcugcuccgcgaguacgggcaguuuuguucaaagaucaaccaggcgcugcacggagcuaauuuaagacaagaugacagugugaggaaccuguucgccagcguaaaaucuucccagucaaguccaauuauccccggcuuugguggggacuucaaucuuacauugcucgagccugucagcauauccacuggcucucguucggcacggagcgccaucgaagaucugcuauuugacaaggugaccauugcugaucccggauacaugcagggcuaugacgauugcaugcagcaagggccagccucagcacgagaccugaucugugcucaguacguggccggauauaaaguccucccuccccugauggauguuaacauggaggcggccuacacguccagucuuuugggcucuauugcuggugugggguggacagcaggacugagcuccuucgccgcuaucccauuugcccagucaauauucuauagauuaaauggcguagguauuacccaacaggugcucucugaaaaccagaagcugaucgcaaauaaauuuaaccaggcgcuuggcgccaugcaaacuggguucacaaccacuaaugaggcuuuucagaagguccaggacgccgugaacaacaaugcacaggcucugagcaaguuggccagugaacucuccaacaccuucggagcaauuagcgccucuaucggcgauauaauccaaaggcuggacguucuagagcaggaugcucagauugaccgccugaucaaugggcggcucacaacgcugaacgcguucguggcccagcaacuugucagaucagaguccgcagcuuugagugcccagcuggccaaagauaaggugaaugaaugcguuaaagcucagagcaagaggucgggauuuuguggccaggguacccauauugugucuuucgucguaaacgcaccgaauggguuauacuuuaugcacgugggauauuacccuuccaaccauaucgagguugugagcgccuacggccucugcgacucagcgaaucccacuaacuguauagcuccagucaaugguuauuucauuaaaacaaacaauacccgcaucguggacgaauggaguuacacagggucuuccuuuuaugcccccgagccuaucacuagccugaacaccaaguacguagcaccacaagugacguaucagaauauuucaacaaaccuucccccuccgcugcuagggaacaguaccggaaucgauuuccaggacgagcucgaugaauuuuucaagaaugucagcacuuccauuccaaacuuuggcucucugacccaaauaaauacaacuuugcuggacuuaaccuacgagaugcucagccugcagcagguugugaaagcccuuaacgaauccuauaucgaucugaaggaguuggggaauuacacauacuauaacaaauggcccugguacauuuggcucggauucaucgcuggccugguggcacuagcccugugcgucuuuuucauucuuuguugcacggguugugggaccaauugcaugggaaagcucaaaugcaaccgauguugcgaccgguaugaagaguacgaucuggagccucacaaggugcauguucacuga

SEQ ID NO: 612 - RNA, 4062 nt, Artificial Sequence
  derived and/or modified CDS sequence (opt3) from MERS-CoV__AGN52936__S
augauccacagcguguuccugcucauguuucuucugacccccacagaguccuacgucgacguuggcccugauucuauuaagucagccugcauagaaguggacauccagcaaacuuucuuugauaaaacguggccaagaccgauugacguaaguaaggcugaugggaucauuuauccccagggaaggaccuacagcaacaucacaauaacuuaucaggguuuguucccuuaccagggcgaccauggggauauguauguguacuccgcaggacacgccaccggcacaaccccacaaaaauuauuugucgcgaauuauucucaggacgugaagcaguucgcuaacgguuuuguugugcggaucggggccgcagccaauucgacuggaacagucauuaucucacccagcaccagugcuacgauucgcaaaaucuacccugcauucaugcugggcuccucugugggcaacuuuagcgaugggaagaugggacgauucuuuaaucauacucuaguacuccugccagacgguuguggcacccuucugcgugccuucuacugcauauuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauuacugaggaugaaauccuggagugguucgguauuacacagaccgcccaagggguucaccucuuuucaagccgcuauguggacuuauacggaggcaauauguuccaguuugcuacucugccggucuacgacacaaucaaauauuacaguaucauuccccacucuauaagauccauccagagcgauaggaaggccugggcagcuuucuauguguacaaacuucagccuuugaccuuucugcuagacuucucgguggauggcuauauucggcgcgccaucgacugcggguuuaacgaucucucucaacugcauuguuccuacgagucauucgacgucgaaaguggaguuuauagcguguccucuuuugaggcgaagccaagcgguucaguaguggaacaggccgagggcgucgagugcgauuucaguccccuucuguccgggacgccuccacagguguacaacuuuaaacgauugguuuucaccaauuguaacuacaaucucacaaagcuguuaagccuguucucugugaacgacuuuacuugcucacaaauaagucccgcagcuauugccagcaauuguuauuccucucucauccuugauuacuucucguauccgcugagcaugaaguccgacuugucagucaguucugcuggaccuaucagccaguuuaacuacaaacaguccuucucaaauccaaccugccuaauucuggccacagugccccacaaccucacuaccaucacaaagccucugaaauauagcuacauuaauaagugcucuagacuucuguccgaugacaggaccgaaguaccccaguugguuaacgcaaaucaauauaguccaugugugagcauaguccccucuacugugugggaggacggcgauuacuaccggaaacagcucuccccucuggaaggugggggcugguuagucgccucaggaaguacgguggcuaugacagagcagcugcagaugggcuuugggaucaccguucaauauggaacugacaccaacagcgugugcccaaagcuagaguucgcgaaugauacaaaaauugcaucgcagcucgguaacuguguagaauacucccuguauggcgucucugggcguggaguguuucagaauugcaccgccguuggcgugcgccagcaaagauucgucuacgacgcuuaucagaaccuuguggguuacuauagcgaugacgggaacuacuacuguuugagggccugcguaucagugccgguuagugucaucuaugauaaggagacuaagacacaugcaacgcuguuuggcuccguggccugugaacacaucucuagcaccaugucccaguacucacggagcacucgaaguaugcucaaacgcagagacucuacauauggaccccugcagaccccugugggcugcguccuugggcugguuaauuccagcuuguucguggaggauuguaagcucccacugggacaaucguuaugcgcucugcccgacacaccuucaacucuaaccccaaggucugugcggaguguacccggugaaaugcgccucgccuccauugcauuuaaccacccgauacaggucgaucagcugaauagcucuuacuucaaacuuagcaucccuacgaacuuuuccuucggcgugacccaagaguauauucagacaacuauccagaagguuaccguggacuguaaacaguacgucugcaauggguuccaaaagugcgaacaguugcugagagaguauggacaguuuuguucaaagauuaaccaggcgcuccauggcgcuaaucugaggcaagaugacagugugcguaacuuauucgccagcguuaaaucuucccagucaaguccaaucauacccgguuuugggggcgacuucaaucugacacuuuuggagccugugagcaucuccacuggaucucggucggcacgaagcgccauugaagaucuccuguuugacaagguaaccaucgcugaucccggcuacaugcagggguacgacgauugcaugcagcaaggaccagccucagcaagagaccuaauuugugcucaguaugucgccggcuacaaagugcugccuccccucauggaugugaacauggaggcggccuauacguccagucugcuugguucuaucgcuggggucggauggacagcaggcuugagcuccuucgccgcuauaccauuugcccagucaauuuucuacaggcugaaugguguuggcaucacccaacagguguuaucugaaaaccagaagcucauugcaaauaaauuuaaccaggcgcugggggccaugcaaacuggauucacaaccacuaaugaggcuuuucacaagguacaggacgccgugaacaacaaugcacaggcucuuagcaagcuggccagugaauuguccaacaccuucggcgcaaucagcgccucuauaggggauaucauucagcgccucgacguccuggagcaagaugcucagaucgaccggcuaauuaauggaagacugacaacgcucaacgcguucguggcccagcagcugguuaggucagaguccgcagcucuuagugcccaauuggccaaagauaaggugaaugaaugcgucaaagcucagagcaagcgcucgggcuuuuguggucaggggacccauaucgugucuuucguugugaacgcaccgaauggacuguauuuuaugcacgucggcuacuauccuuccaaccauauagagguagugagcgccuacgguuuaugcgacgcggcuaaucccacuaacuguauugccccaguuaauggcuacuucaucaaaacaaacaauacccgaaucguggacgaauggucauauacagggaguucuuuuuacgcacccgagccuauuacuucccucaacaccaaguaugucgccccacaggugacguaccaaaauaucagcacaaaccugcccccuccgcuucugggaaacucaaccggcauugauuuccaggacgagcuagaugaauuuuucaagaauguaaguacuagcauaccaaacuuugggucccucacccagaucaauacaacucuguuggaccugaccuaugagauguuaucucuccaacagguggucaaagcucugaacgaaagcuacauugaucuuaaggagcugggaaauuauacauacuacaacaaauggcccugguauaucugguugggcuucauugcaggucucguugcccuggcgcuaugcguguuuuucauccuguguugcacgggguguggaaccaauugcaugggcaaacuuaagugcaaccgguguugcgaccguuacgaagaguaugaucucgagccucacaaggugcacguccauuga

SEQ ID NO: 613 - RNA, 4062 nt, Artificial Sequence
  derived and/or modified CDS sequence (opt3) from MERS-CoV__AGN70951__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaguucgcgaaugauacaaaaaucgcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaagacacaugcaacgcuguuuggcuccguggccugugaacacaucucuagcaccaugucccaguacucacggagcacucgaaguaugcucaaacgcagagacucuacauauggaccccugcagaccccugucggcugcguucuugggcugguaaauuccagcuuguucguggaggauuguaagcucccacugggacaaucguuaugcgcucugcccgacacaccuucaacucuaaccccaaggucugugcggaguguccccggugaaaugcgccucgccuccaucgcauuuaaccacccgauucagguggaucagcugaauagcucuuacuucaaacuuagcauaccuacgaacuuuuccuucggcguuacccaagaguauauccagacaacuauucagaaggugaccgucgacuguaaacaguacgugugcaauggguuccaaaagugcgaacaguugcugagagaguauggacaguuuuguucaaagaucaaccaggcgcuccauggcgcuaaucugaggcaagaugacaguguucguaacuuauucgccagcgugaaaucuucccagucaaguccaauuauccccgguuuugggggcgacuucaaucugacacuuuuggagccuguaagcauauccacuggaucucggucggcacgaagcgccaucgaagaucuccuguuugacaaggucaccauugcugaucccggcuacaugcagggguacgacgauugcaugcagcaaggaccagccucagcaagagaccuaaucugugcucaguauguggccggcuacaaagugcugccuccccucauggaugucaacauggaggcggccuauacguccagucugcuugguucuauugcugggguuggauggacagcaggcuugagcuccuucgccgcuaucccauuugcccagucaauauucuacaggcugaauggugugggcauuacccaacagguauuaucugaaaaccagaagcucaucgcaaauaaauuuaaccaggcgcugggggccaugcaaacuggauucacaaccacuaaugaggcuuuucgcaaggugcaggacgccgucaacaacaaugcacaggcucuuagcaagcuggccagugaauuguccaacaccuucggcgcaauuagcgccucuaucggggauauaauccagcggcucgacgugcuggagcaagaugcucagauugacagacuaaucaauggaaggcugacaacgcucaacgcguucguugcccagcagcuggugcgcucagaguccgcagcucuuagugcccaauuggccaaagauaaggucaaugaaugcgugaaagcucagagcaagcgaucgggcuuuuguggucaggggacccacauuguuucuuucguggucaacgcaccgaauggacuguauuuuaugcauguaggcuacuauccuuccaaccacaucgaggugguuagcgccuacgguuuaugcgacgcggcuaaucccacuaacuguauagccccagugaauggcuacuucauuaaaacaaacaauacccggaucgucgacgaauggucauauacagggaguucuuuuuacgcacccgagccuaucacuucccucaacaccaaguauguggccccacauguaacguaccagaauauuagcacaaaccugcccccuccgcuucugggaaacucaaccggcaucgauuuccaagacgagcuagaugaauuuuucaagaaugugaguacuagcauuccaaacuuugggucccucacccagauaaauacaacucuguuggaccugaccuaugagauguuaucucuccagcaagucguuaaagcucugaacgaaagcuacaucgaucuuaaggagcugggaaauuauacauacuacaacaaauggcccugguauauuugguugggcuucaucgcaggucucguggcccuggcgcuaugcguguuuuucauucuguguugcacgggguguggaaccaauugcaugggcaaacuuaagugcaaccguuguugcgacagauacgaagaguaugaucucgagccucacaagguccacgugcauuga

SEQ ID NO: 614 - RNA, 4062 nt, Artificial Sequence
  derived and/or modified CDS sequence (opt3) from MERS-CoV__AGV08408__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccggcgauaggaccgaaguuccccaguuggugaacgcaaaucaauauaguccaugugucagcauugugcccucuacugucugggaggacggugacuacuaccggaaacagcucuccccucuggaagggggcggaugguuaguggccucaggcaguacgguugcuaugacagagcagcugcagaugggguuuggaauaaccgugcaauaugguacugauaccaacagcguaugcccaaagcuagaguucgcgaaugacacaaaaaucgcaucgcagcucggcaacugugucgaauacucccuguauggggugucuggacguggcguuuuucagaauugcaccgccguggguguccgccagcaaagauucguguacgaugcuuaucagaaccuuguaggguacuauagcgacgauggcaacuacuacuguuugagggccugcgugucaguuccggucagugugauuuaugacaaggagacuaagacacaugcaacgcuguuuggauccguggccugugaacacaucucuagcaccaugucccaguacucacggagcacucgaaguaugcucaaacgcagagauucuacauauggcccccugcagaccccugucgggugcguucuuggacugguaaauuccagcuuguucguggaggacuguaagcucccacugggucaaucguuaugcgcucugcccgauacaccuucaacucuaaccccaaggucugugcggaguguccccggcgaaaugcgccucgccuccaucgcauuuaaccacccgauucagguggaccagcugaauagcucuuacuucaaacuuagcauaccuacgaacuuuuccuucgggguuacccaagaguauauccagacaacuauucagaaggugaccgucgauuguaaacaguacgugugcaauggauuccaaaagugcgaacaguugcugagagaguauggccaguuuuguucaaagaucaaccaggcgcuccauggugcuaaucugaggcaagacgauaguguucguaacuuauucgccagcgugaaaucuucccagucaaguccaauuauccccggguuuggcggagacuucaaucugacacuuuuggagccuguaagcauauccacuggcucucggucggcacgaagcgccaucgaagaccuccuguuugauaaggucaccauugcugaccccggguacaugcagggauacgaugacugcaugcagcaaggcccagccucagcaagagaucuaaucugugcucaguauguggccgguuacaaagugcugccuccccucauggacgucaacauggaggcggccuauacguccagucugcuugggucuauugcuggaguuggcuggacagcagguuugagcuccuucgccgcuaucccauuugcccagucaauauucuacaggcugaauggcguggggauuacccaacagguauuaucugaaaaccagaagcucaucgcaaauaaauuuaaccaggcgcugggagccaugcaaacuggcuucacaaccacuaaugaggcuuuucgcaaggugcaggaugccgucaacaacaaugcacaggcucuuagcaagcuggccagugaauuguccaacaccuucggggcaauuagcgccucuaucggagacauaauccagcggcucgaugugcuggagcaagacgcucagauugauagacuaaucaauggcaggcugacaacgcucaacgcguucguugcccagcagcuggugcgcucagaguccgcagcucuuagugcccaauuggccaaagacaaggucaaugaaugcgugaaagcucagagcaagcgaucggguuuuugugggcagggaacccacauuguuucuuucguggucaacgcaccgaauggccuguauuuuaugcauguagguuacuauccuuccaaccacaucgaggugguuagcgccuacggcuuaugcgaugcggcuaaucccacuaacuguauagccccagugaauggguacuucauuaaaacaaacaauacccggaucgucgacgaauggucauauacaggaaguucuuuuuacgcacccgagccuaucacuucccucaacaccaaguauguggccccacagguaacguaccaaaauauuagcacaaaccugcccccuccgcuucugggcaacucaaccgggaucgacuuccaggaugagcuagacgaauuuuucaagaaugugaguacuagcauuccaaacuuuggaucccucacccagauaaauacaacucuguuggaucugaccuaugagauguuaucucuccaacaggucguuaaagcucugaacgaaagcuacaucgaccuuaaggagcugggcaauuauacauacuacaacaaauggcccugguauauuugguuggguuucaucgcagggcucguggcccuggcgcuaugcguguuuuucauucuguguugcacgggauguggcaccaauugcauggguaaacuuaagugcaaccguuguugcgauagauacgaagaguaugaccucgagccucauaagguccacgugcacuga

SEQ ID NO: 615 - RNA, 4062 nt, Artificial Sequence
  derived and/or modified CDS sequence (opt3) from MERS-CoV__AGV08455__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcuacgggaagaugggacgauucuuuaaucauacucuaguucuccugccagaugguuguggcacccuucugcgugccuucuauugcaucuuggagcccagauccgggaaccacuguccugcuggaaauucauacacaaguuuugccacuuaucauaccccagcgacagacugcagcgauggcaacuacaauaggaacgcaucucucaauuccuucaaggaauauuucaaccugcggaauuguaccuuuauguacacguauaacauaacugaggacgaaauucuggagugguucgguaucacacagaccgcccaaggggugcaccucuuuucaagccgcuacgucgauuuauacggaggcaauauguuccaguuugcuacucugccgguguaugacacaauuaaauacuauaguaucaucccccacucuauuagauccauacagagcgacaggaaggccugggcagcuuucuacguguauaaacuucagccuuugaccuuucugcuagauuucucggucgacggcuacauccggcgcgccauugauugcggguuuaacgaccucucucaacugcauuguuccuaugagucauucgauguugaaaguggaguguacagcguauccucuuuugaggcgaagccaagcgguucaguggucgaacaggccgagggcguggagugcgacuucaguccccuucuguccgggacgccuccacagguuuacaacuuuaaacgauugguguucaccaauuguaacuauaaucucacaaagcuguuaagccuguucucugucaacgauuuuacuugcucacaaaucagucccgcagcuauagccagcaauuguuacuccucucucauucuugacuauuucucguacccgcugagcaugaaguccgauuugucagugaguucugcuggaccuaucagccaguuuaacuauaaacaguccuucucaaauccaaccugccuaauccuggccacaguaccccacaaccucacuaccauuacaaagccucugaaauacagcuauaucaauaagugcucuagacuucuguccgacgauaggaccgaaguuccccaguuggugaacgcaaaucaauacaguccaugugucagcauugugcccucuacugucugggaggacggcgacuacuaucggaaacagcucuccccucuggaaggugggggcugguuaguggccucaggaaguacgguugcuaugacagagcagcugcagaugggcuuugggauaaccgugcaauacggaacugauaccaacagcguaugcccaaagcuagaguucgcgaaugacacaaaaaucgcaucgcagcucgguaacugugucgaauauucccuguacggcgugucugggcguggaguuuuucagaauugcaccgccgugggcguccgccagcaaagauucguguaugaugcuuaccagaaccuuguagguuauuacagcgacgaugggaacuacuauuguuugagggccugcgugucaguuccggucagugugauuuacgacaaggagacuaagacacaugcaacgcuguuuggcuccguggccugugaacacaucucuagcaccaugucccaguauucacggagcacucgaaguaugcucaaacgcagagauucuacauacggaccccugcagaccccugucggcugcguucuugggcugguaaauuccagcuuguucguggaggacuguaagcucccacugggacaaucguuaugcgcucugcccgauacaccuucaacucuaaccccaaggucugugcggaguguccccggugaaaugcgccucgccuccaucgcauuuaaccacccgauucagguggaccagcugaauagcucuuauuucaaacuuagcauaccuacgaacuuuuccuucggcguuacccaagaguacauccagacaacuauucagaaggugaccgucgauuguaaacaguaugugugcaauggguuccaaaagugcgaacaguugcugagagaguacggacaguuuuguucaaagaucaaccaggcgcuccauggcgcuaaucugaggcaagacgauaguguucguaacuuauucgccagcgugaaaucuucccagucaaguccaauuauccccgguuuugggggcgacuucaaucugacacuuuuggagccuguaagcauauccacuggaucucggucggcacgaagcgccaucgaagaccuccuguuugauaaggucaccauugcugaccccggcuacaugcagggguaugaugacugcaugcagcaaggaccagccucagcaagagaucuaaucugugcucaguacguggccggcuauaaagugcugccuccccucauggacgucaacauggaggcggccuacacguccagucugcuugguucuauugcugggguuggauggacagcaggcuugagcuccuucgccgcuaucccauuugcccagucaauauucuauaggcugaauggugugggcauuacccaacagguauuaucugaaaaccagaagcucaucgcaaauaaauuuaaccaggcgcugggggccaugcaaacuggauucacaaccacuaaugaggcuuuucgcaaggugcaggaugccgucaacaacaaugcacaggcucuuagcaagcuggccagugaauuguccaacaccuucggcgcaauuagcgccucuaucggggacauaauccagcggcucgaugugcuggagcaagacgcucagauugauagacuaaucaauggaaggcugacaacgcucaacgcguucguugcccagcagcuggugcgcucagaguccgcagcucuuagugcccaauuggccaaagacaaggucaaugaaugcgugaaagcucagagcaagcgaucgggcuuuuguggucaggggacccacauuguuucuuucguggucaacgcaccgaauggacuguacuuuaugcauguaggcuauuacccuuccaaccacaucgaggugguuagcgccuacgguuuaugcgaugcggcuaaucccacuaacuguauagccccagugaauggcuauuucauuaaaacaaacaauacccggaucgucgacgaauggucauacacagggaguucuuuuuaugcacccgagccuaucacuucccucaacaccaaguacguggccccacagguaacguaucaaaauauuagcacaaaccugcccccuccgcuucugggaaacucaaccggcaucgacuuccaggaugagcuagacgaauuuuucaagaaugugaguacuagcauuccaaacuuugggucccucacccagauaaauacaacucuguuggaucugaccuacgagauguuaucucuccaacaggucguuaaagcucugaacgaaagcuauaucgaccuuaaggagcugggaaauuacacauacuauaacaaauggcccugguacauuugguugggcuucaucgcaggucucguggcccuggcgcuaugcguguuuuucauucuguguugcacgggguguggaaccaauugcaugggcaaacuuaagugcaaccguuguugcgauagauaugaagaguacgaccucgagccucauaagguccacgugcacuga

SEQ ID NO: 616 - RNA, 4062 nt, Artificial Sequence
  derived and/or modified CDS sequence (opt3) from MERS-CoV__AGV08467__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaguucgcgaaugauacaaaaaucgcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaagacacaugcaacgcuguuuggcuccguggccugugaacacaucucuagcaccaugucccaguacucacggagcacucgaaguaugcucaaacgcagagacucuacauauggaccccugcagaccccugucggcugcguucuugggcugguaaauuccagcuuguucguggaggauuguaagcucccacugggacaaucguuaugcgcucugcccgacacaccuucaacucuaaccccaaggucugugcggaguguccccggugaaaugcgccucgccuccaucgcauuuaaccacccgauucagguggaucagcugaauagcucuuacuucaaacuuagcauaccuacgaacuuuuccuucggcguuacccaagaguauauccagacaacuauucagaaggugaccgucgacuguaaacaguacgugugcaauggguuccaaaagugcgaacaguugcugagagaguauggacaguuuuguucaaagaucaaccaggcgcuccauggcgcuaaucugaggcaagaugacaguguucguaacuuauucgccagcgugaaaucuucccagucaaguccaauuauccccgguuuugggggcgacuucaaucugacacuuuuggagccuguaagcauauccacuggaucucggucggcacgaagcgccaucgaagaucuccuguuugacaaggucaccauugcugaucccggcuacaugcagggguacgacgauugcaugcagcaaggaccagccucagcaagagaccuaaucugugcucaguauguggccggcuacaaagugcugccuccccucauggaugucaacauggaggcggccuauacguccagucugcuugguucuauugcugggguuggauggacagcaggcuugagcuccuucgccgcuaucccauuugcccagucaauauucuacaggcugaauggugugggcauuacccaacagguauuaucugaaaaccagaagcucaucgcaaauaaauuuaaccaggcgcugggggccaugcaaacuggauucacaaccacuaaugaggcuuuucgcaaggugcaggacgccgucaacaacaaugcacaggcucuuagcaagcuggccagugaauuguccaacaccuucggcgcaauuagcgccucuaucggggauauaauccagcggcucgacgugcuggagcaagaugcucagauugacagacuaaucaauggaaggcugacaacgcucaacgcguucguugcccagcagcuggugcgcucagaguccgcagcucuuagugcccaauuggccaaagauaaggucaaugaaugcgugaaagcucagagcaagcgaucgggcuuuuguggucaggggacccacauuguuucuuucguggucaacgcaccgaauggacuguauuuuaugcauguaggcuacuauccuuccaaccacaucgaggugguuagcgccuacgguuuaugcgacgcggcuaaucccacuaacuguauagccccagugaauggcuacuucauuaaaacaaacaauacccggaucgucgacgaauggucauauacagggaguucuuuuuacgcacccgagccuaucacuucccucaacaccaaguauguggccccacagguaacguaccaaaauauuagcacaaaccugcccccuccgcuucugggaaacucaaucggcauugauuuccaggacgagcuagaugaauuuuucaagaaugugaguaccagcauaccaaacuuugggucccucacucagaucaauaccacacuguuggaccugacuuaugagauguuaucucuccaacaggucguuaaagcucugaacgaaagcuacauugaucuuaaggagcugggaaauuauaccuacuacaacaaauggcccugguauaucugguugggcuucauugcaggucucguggcccuggcgcuaugcguguuuuucauccuguguugcacaggguguggaacgaauugcaugggcaaacuuaagugcaaccguuguugcgacagauacgaagaguaugaucucgagccucauaagguccacgugcacuga

SEQ ID NO: 617 - RNA, 4062 nt, Artificial Sequence
  derived and/or modified CDS sequence (opt3) from MERS-CoV__AGV08492__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaguucgcgaaugauacaaaaaucgcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaagacacaugcaacgcuguuuggcuccguggccugugaacacaucucuagcaccaugucccaguacucacggagcacucgaaguaugcucaaacgcagagacucuacauauggaccccugcagaccccugucggcugcguucuugggcugguaaauuccagcuuguucguggaggauuguaagcucccacugggacaaucguuaugcgcucugcccgacacaccuucaacucuaaccccaaggucugugcggaguguccccggugaaaugcgccucgccuccaucgcauuuaaccacccgauucagguggaucagcugaauagcucuuacuucaaacuuagcauaccuacgaacuuuuccuucggcguuacccaagaguauauccagacaacuauucagaaggugaccgucgacuguaaacaguacgugugcaauggguuccaaaagugcgaacaguugcugagagaguauggacaguuuuguucaaagaucaaccaggcgcuccauggcgcuaaucugaggcaagaugacaguguucguaacuuauucgccagcgugaaaucuucccagucaaguccaauuauccccgguuuugggggcgacuucaaucugacacuuuuggagccuguaagcauauccacuggaucucggucggcacgaagcgccaucgaagaucuccuguuugacaaggucaccauugcugaucccggcuacaugcagggguacgacgauugcaugcagcaaggaccagccucagcaagagaccuaaucugugcucaguauguggccggcuacaaagugcugccuccccucauggaugucaacauggaggcggccuauacguccagucugcuugguucuauugcugggguuggauggacagcaggcuugagcuccuucgccgcuaucccauuugcccagucaauauucuacaggcugaauggugugggcauuacccaacagguauuaucugaaaaccagaagcucaucgcaaauaaauuuaaccaggcgcugggggccaugcaaacuggauucacaaccacuaaugaggcuuuucgcaaggugcaggacgccgucaacaacaaugcacaggcucuuagcaagcuggccagugaauuguccaacaccuucggcgcaauuagcgccucuaucggggauauaauccagcggcucgacgugcuggagcaagaugcucagauugacagacuaaucaauggaaggcugacaacgcucaacgcguucguuucacagcagcuggugcgcuccgagagugccgcacuuagcgcucaauuggccaaagauaaggucaaugaaugcgugaaagcccagucgaagcgaucuggcuuuuguggucaggggacccacauuguuuccuucguggucaacgcuccgaauggacuguauuuuaugcauguaggcuacuauccuagcaaccacaucgaggugguuucagcauacgguuuaugcgacgccgcgaaucccacuaacuguauagcuccagugaauggcuacuucauuaaaacaaacaauacccggaucgucgacgaauggaguuauacagggucuuccuuuuacgcccccgagccuaucacuagccucaacaccaaguauguggcaccacauguaacguaccagaauauuucaacaaaccugcccccuccgcuucugggaaacaguaccggcaucgauuuccaagacgagcuagaugaauuuuucaagaaugugagcacuuccauuccaaacuuugggucucucacccagauaaauacaacucuguuggaccugaccuaugagauguuaagccuccagcaagucguuaaagcccugaacgaauccuacaucgaucuuaaggagcugggaaauuauacauacuacaacaaauggcccugguauauuugguugggcuucaucgcuggucucguggcacuggcccuaugcguguuuuucauucuguguugcacgggguguggaaccaauugcaugggcaaacuuaagugcaaccguuguugcgacagauacgaagaguaugaucucgagccucacaagguccacgugcauuga

SEQ ID NO: 618 - RNA, 4062 nt, Artificial Sequence
  derived and/or modified CDS sequence (opt3) from MERS-CoV__AGV08584__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugccugggaggacggcgauuacuaccggaaacagcucuccccucuggaaggugggggcugguuagucgcuucaggaaguacgguggcgaugacagagcagcugcagaugggcuuugggauaaccguucaauauggaacugacaccaacagcgugugcccaaagcuagaguucgcaaaugauacaaaaaucgccucgcagcucgguaacuguguagaauacucccuguauggcgucucugggcguggaguguuucagaauugcaccgcuguuggcgugcgccagcaaagauucgucuacgacgccuaucagaaccuuguggguuacuauagcgaugacgggaacuacuacuguuugagggcaugcguaucagugccgguuagugucauuuaugauaaggagacuaagacacaugccacgcuguuuggcuccguggcuugugaacacaucucuagcaccaugucccaguacucacggagcacucgaaguaugcucaaacgcagagacucuacauauggaccccugcagaccccugugggcugcguccuugggcugguuaauuccagcuuguucguggaggauuguaagcucccacugggacaaucguuaugcgcccugcccgacacaccuucaacucuaaccccaaggucugugcggaguguacccggugaaaugcgccucgcauccaucgcguuuaaccacccgauucaggucgaucagcugaauagcucuuacuucaaacuuagcauaccuacgaacuuuuccuucggcgugacccaagaguauauccagacaacuauucagaagguuaccguggacuguaaacaguacgucugcaauggguuccaaaagugcgaacaguugcugagagaguauggacaguuuuguucaaagaucaaccaggcucuccauggcgccaaucugaggcaagaugacagugugcguaacuuauucgcaagcguuaaaucuucccagucaaguccaauuauccccgguuuugggggcgacuucaaucugacacuuuuggagccugugagcauauccacuggaucucggucggcccgaagcgcuaucgaagaucuccuguuugacaagguaaccauugccgaucccggcuacaugcagggguacgacgauugcaugcagcaaggaccagcaucagcuagagaccuaaucugugcccaguaugucgcgggcuacaaagugcugccuccccucauggaugugaacauggaggccgcuuauacguccagucugcuugguucuauugcaggggucggauggacagccggcuugagcuccuucgcugccaucccauuugcacagucaauauucuacaggcugaaugguguuggcauuacccaacagguguuaucugaaaaccagaagcucaucgcgaauaaauuuaaccaggcccugggggcuaugcaaacuggauucacaaccacuaaugaggccuuucgcaagguacaggacgcagugaacaacaaugcucaggcccuuagcaagcuggcaagugaauuguccaacaccuucggcgccauuagcgcuucuaucggggauauaauccagcggcucgacguccuggagcaagaugcgcagauugacagacuaaucaauggaaggcugacaacgcucaacgccuucguggcacagcagcugguucgcucagaguccgcugcccuuagugcccaauuggcuaaagauaaggugaaugaaugcgucaaagcacagagcaagcgaucgggcuuuuguggucaggggacccacauugugucuuucguugugaacgccccgaauggacuguauuuuaugcaugucggcuacuauccuuccaaccacaucgagguagugagcgcguacgguuuaugcgacgcugccaaucccacuaacuguauagcaccaguuaauggcuacuucauuaaaacaaacaauacccggaucguggacgaauggucauauacagggaguucuuuuuacgcccccgagccuaucacuucccucaacaccaaguaugucgcuccacaggugacguaccaaaauauuagcacaaaccugcccccuccgcuucugggaaacucaaccggcaucgauuuccaggacgagcuagaugaauuuuucaagaauguaaguacuagcauuccaaacuuugggucccucacccagauaaauacaacucuguuggaccugaccuaugagauguuaucucuccaacagguggucaaagcacugaacgaaagcuacaucgaucuuaaggagcugggaaauuauacauacuacaacaaauggcccugguauauuugguugggcuucaucgccggucucguugcgcuggcucuaugcguguuuuucauucuguguugcacgggguguggaaccaauugcaugggcaaacuuaagugcaaccguuguugcgacagauacgaagaguaugaucucgagccucauaaggugcacguccacuga

SEQ ID NO: 619 - RNA, 4062 nt, Artificial Sequence
  derived and/or modified CDS sequence (opt3) from MERS-CoV__AHB33326__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccuacucgacuggaacagugaucauuucacccagcaccagugcuacgauccgcaaaauuuacccugcauucaugcugggcuccucuguaggcaauuuuagcgaugggaagaugggacgauucuuuaaccauacucuaguucuccugccagacgguuguggcacccuucugcgugccuucuauugcaucuuggagcccagauccgggaaucacuguccugcuggaaacucauacacaaguuuugccacuuaucauaccccagcgacagauugcagcgacggcaauuacaacaggaaugcaucucucaacuccuucaaggaauauuucaaucugcggaacuguaccuuuauguacacguauaauauaacugaggaugaaauucuggagugguucgguaucacacagaccgcccaaggggugcaccucuuuucaagccgcuacgucgacuuauacggaggcaacauguuccaguuugcuacucugccgguguaugacacaauuaaauacuauaguaucaucccccacucuauuagauccauacagagcgauaggaaggccugggcagcuuucuacguguauaaacuucagccuuugaccuuucugcuagacuucucggucgauggcuacauccggcgcgccauugacugcggguuuaaugaucucucucaacugcauuguuccuaugagucauucgacguugaaaguggaguguacagcguauccucuuuugaggcgaagccaagcgguucaguggucgaacaggccgagggcguggagugcgauuucaguccccuucuguccgggacgccuccacagguuuacaacuuuaaacgauugguguucaccaacuguaauuauaaccucacaaagcuguuaagccuguucucugucaaugacuuuacuugcucacaaaucagucccgcagcuauagccagcaacuguuacuccucucucauucuugauuauuucucguacccgcugagcaugaaguccgacuugucagugaguucugcuggaccuaucagccaguuuaauuauaaacaguccuucucaaacccaaccugccuaauccuggccacaguaccccacaaucucacuaccauuacaaagccucugaaauacagcuauaucaacaagugcucuagacuucuguccgaugacaggaccgaaguuccccaguuggugaaugcaaaccaauacaguccaugugucagcauugugcccucuacugucugggaggacggcgauuacuaucggaaacagcucuccccucuggaaggugggggcugguuaguggccucaggaaguacgguugcuaugacagagcagcugcagaugggcuuugggauaaccgugcaauacggaacugacaccaauagcguaugcccaaagcuagaguucgcgaacgauacaaaaaucgcaucgcagcucgguaauugugucgaauauucccuguacggcgugucugggcguggaguuuuucagaacugcaccgccgugggcguccgccagcaaagauucguguaugacgcuuaccagaaucuuguagguuauuacagcgaugacgggaacuacuauuguuugagggccugcgugucaguuccggucagugugauuuacgauaaggagacuaagacacaugcaacgcuguuuggcuccguggccugugaacacaucucuagcaccaugucccaguauucacggagcacucgaaguaugcucaaacgcagagacucuacauacggaccccugcagaccccugucggcugcguucuugggcuggugaacuccagcuuguucguggaggauuguaagcucccacugggacaaucguuaugcgcucugcccgacacaccuucaacucuaaccccaaggucuguacggaguguccccggugaaaugcgccucgccuccaucgcauuuaaucacccgauucagguggaucagcugaacagcucuuauuucaaacuuagcauaccuacgaauuuuuccuucggcguuacccaagaguacauccagacaacuauucagaaggugaccgucgacuguaaacaguaugugugcaacggguuccaaaagugcgaacaguugcugagagaguacggacaguuuuguucaaagaucaaucaggcgcuccauggcgcuaaccugaggcaagaugacaguguucguaauuuauucgccagcgugaaaucuucccagucaaguccaauuauccccgguuuugggggcgacuucaaccugacacuuuuggagccuguaagcauauccacuggaucucggucggcacgaagcgccaucgaagaucuccuguuugacaaggucaccauugcugaucccggcuacaugcagggguaugacgauugcaugcaccagggaccagccucagcaagagaccuaaucugugcucaauacguggccggcuauaaagugcugccuccccucauggaugucaauauggaggcggccuacacguccagucugcuugguucuauugcugggguuggauggacagcaggcuugagcuccuucgccgcuaucccauuugcccagucaauauucuauaggcugaacggugugggcauuacccagcaaguauuaucugaaaaucagaagcucaucgcaaacaaauuuaaucaggcgcugggggccaugcagacuggauucacaaccacuaacgaggcuuuucgcaaggugcaagacgccgucaauaacaacgcacaggcucuuagcaagcuggccagugaauuguccaauaccuucggcgcaauuagcgccucuaucggggauauaauccagcggcucgacgugcuggagcaggaugcucaaauugacagacuaaucaacggaaggcugacaacgcucaaugcguucguugcccagcagcuggugcgcucagaguccgcagcucuuagugcccaguuggccaaagauaaggucaacgaaugcgugaaagcucaaagcaagcgaucgggcuuuuguggucaggggacccauauuguuucuuucguggucaaugcaccgaacggacuguacuuuaugcacguaggcuauuacccuuccaaucauaucgaggugguuagcgccuacgguuuaugcgacgcggcuaaccccacuaauuguauagccccagugaacggcuauuucauuaaaacaaauaacacccggaucgucgacgaauggucauacacagggaguucuuuuuauucccccgagccuaucacuagccucaauaccaaguacguggcaccacagguaacguaucagaacauuucaacaaaucugcccccuccgcuucugggaaacaguaccggcaucgauuuccaagacgagcuagaugaauuuuucaagaacgugagcacuuccauuccaaauuuugggucucucacccagauaaacacaacucuguuggaccugaccuacgagauguuaagccuccagcaagucguuaaagcccugaaugaauccuauaucgaucuuaaggagcugggaaacuacacauacuauaauaaauggcccugguacauuugguugggcuucaucgcuggucucguggcacuggcccuaugcguguuuuucauucuguguugcacgggguguggaaccaacugcaugggcaaacuuaagugcaaucguuguugcgacagauaugaagaguacgaucucgagccucacaagguccacgugcauuga

SEQ ID NO: 620 - RNA, 4062 nt, Artificial Sequence
  derived and/or modified CDS sequence (opt3) from MERS-CoV__AHC74088__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguuuugcuggaccuaucucucaguucaacuacaaacagagcuuuuccaauccaaccugccuaauccuggccacaguaccccacaaccucacuaccauuacaaagccucugaaauauucauacaucaauaagugcagcagacuucugucugaugacaggaccgaaguuccccaguuggugaacgcaaaucaauauuccccaugugucaguauugugcccagcacugucugggaggacggcgauuacuaccggaaacagcucucuccucuggaaggugggggcugguuaguggccuccggaucaacgguugcuaugacagagcagcugcagaugggcuucgggauaaccgugcaauauggaacugacaccaacaguguaugcccaaagcuagaauuugcgaaugauacaaaaaucgcaagccagcucgguaacugugucgaguacucgcuguauggcguguccgggcguggaguuuuccagaauugcaccgccgugggcguccgccagcaaagauuuguguacgacgcuuaucagaaccuuguagguuacuauucugaugacgggaacuacuacuguuugagggccugcgugagcguuccggucucagugauuuaugauaaggagacuaagacacaugcaacgcuguucggcaguguggccugugaacacaucuccucuaccaugagccaguacucccggucaacucgaagcaugcucaaacgcagagacaguacauauggaccccugcagaccccugucggcugcguucuugggcugguaaauucuuccuuguuuguggaggauuguaagcucccacugggacaaaguuuaugcgcucugcccgacacaccuucgacucuaaccccaaggucagugcggucuguccccggugaaaugcgccucgccaguaucgcauucaaccacccgauucagguggaucagcuuaauuccagcuacuuuaaacuuucuauaccuacgaacuucagcuucggcguuacccaagaguauauccagacaacuauucagaaggugaccgucgacuguaaacaguacgugugcaauggguuucaaaagugcgaacaguugcugagagaguauggacaguucuguuccaagaucaaccaggcgcuccauggcgcuaaucugaggcaagaugacucaguucguaacuuauuugccagugugaaaagcucucaguccucaccaauuauccccgguuucgggggcgacuuuaaucugacacuuuuggagccuguaaguauaagcacuggaucccggucugcacgaucggccaucgaagaucuccuguucgacaaggucaccauugcugaucccggcuacaugcagggguacgacgauugcaugcagcaaggaccagccagcgcaagagaccuaaucugugcucaguauguggccggcuacaaagugcugccuccccucauggaugucaacauggaggcggccuauacgucaucccugcuugguaguauugcugggguuggauggacagcaggcuugucuagcuuugccgcuaucccauucgcccaguccauauuuuacaggcugaauggugugggcauuacccaacagguauuaucagaaaaccagaagcucaucgcaaauaaauucaaccaggcgcugggggccaugcaaacuggauuuacaaccacuaaugaggcuuuccgcaaggugcaggacgccgucaacaacaaugcacaggcucuuucuaagcuggccagcgaauugaguaacaccuucggcgcaauuuccgccagcaucggggauauaauccagcggcucgacgugcuggagcaagaugcucagauugacagacuaaucaauggaaggcugacaacgcucaacgcguuuguugcccagcagcuggugcgcucugagucagcagcucuuuccgcccaauuggccaaagauaaggucaaugaaugcgugaaagcucagaguaagcgaagcggcuucuguggucaggggacccacauuguuucguuuguggucaacgcaccgaauggacuguauuucaugcauguaggcuacuauccuucuaaccacaucgaggugguuuccgccuacgguuuaugcgacgcggcuaaucccacuaacuguauagccccagugaauggcuacuuuauuaaaacaaacaauacccggaucgucgacgaauggagcuauacagggucaaguuucuacgcacccgagccuaucacuucucucaacaccaaguauguggccccacagguaacguaccaaaauauuuccacaaaccugcccccuccgcuucugggaaacagcaccggcaucgauuuucaggacgagcuagaugaguucuuuaagaaugugucaacuagcauuccaaacuucgggagccucacccagauaaauacaacucuguuggaccugaccuaugaaauguuaucccuccaacaggucguuaaagcucugaacgaaucuuacaucgaucuuaaggagcugggaaauuauacauacuacaacaaauggcccugguauauuugguugggcuuuaucgcaggucucguggcccuggcgcuaugcguguucuuuauucuguguugcacgggguguggaaccaauugcaugggcaagcugaaaugcaaccguuguugcgacagauacgaagaguaugaucucgagccucauaagguccacgugcacuga

SEQ ID NO: 621 - RNA, 4062 nt, Artificial Sequence
  derived and/or modified CDS sequence (opt3) from MERS-CoV__AHI48528__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccccggcaauagcuagcaauuguuauuccucucucauucuugauuacuucucguauccucugagcaugaaguccgacuugucagugaguucugccggacccaucagccaguuuaacuacaaacaguccuucucaaauccaaccugccuaauccugguaacaguuccucacaaccucacuaccauuacaaagccccugaaauauagcuacaucaauaagugcucuagacuucuguccgaugacaggaccgaagugccacaguuggucaacgcuaaucaauauagucccugugugagcauugucccuucuacugugugggaggacggcgauuacuaccggaaacagcucuccccacuggaaggugggggcugguuaguugccucaggaaguacgguggcaaugacagagcagcugcagaugggcuuugggauaaccguacaauauggaacugacaccaacagcgucugcccgaagcuagaguucgccaaugauacaaaaaucgcuucgcagcucgguaacuguguggaauacucccuguauggcguuucugggcguggaguguuucagaauugcaccgcggucggcgugcgccagcaaagauucguauacgacgcauaucagaaccuuguggguuacuauagcgaugacgggaacuacuacuguuugagggccugcguuucaguccccgugagugugauuuaugauaaggagacuaagacacaugcuacgcuguuuggcuccgucgccugugaacacaucucuagcaccaugucccaguacucacggagcacucgaaguaugcucaaacgcagagacucuacauauggaccucugcagaccccaguuggcugcgugcuugggcugguaaauuccagcuuguucguggaggauuguaagcucccccugggacaaucguuaugcgcacugccugacacaccaucaacucuaacccccaggucuguccggagugugccgggugaaaugcgccucgccuccaucgcuuuuaaccacccuauucagguugaucagcugaauagcucuuacuucaaacuuagcauaccaacgaacuuuuccuucggcgugacccaagaguauauccagacaacuauucagaaggucaccguggacuguaaacaguacguuugcaauggguuccaaaagugcgaacaguugcugagagaguauggacaguuuuguucaaagaucaaccaggcccuccauggcgcaaaucugaggcaagaugacagugugcguaacuuauucgcgagcguaaaaucuucccagucaagucccauuaucccugguuuugggggcgacuucaaucugacacuuuuggagcccgucagcauauccacuggaucucggucggcucgaagcgccaucgaagaucuccuguuugacaaggugaccauugcagauccaggcuacaugcagggguacgacgauugcaugcagcaaggaccugccucagcuagagaccuaaucugugcccaguauguggcaggcuacaaaguccugcccccacucauggauguuaacauggaggcugccuauacguccagucugcuugguucuauugcgggggugggauggacagccggcuugagcuccuucgcugcaaucccguuugcccagucaauauucuacaggcugaaugguguaggcauuacccaacagguguuaucugaaaaccagaagcucaucgcuaauaaauuuaaccaggcccugggggcaaugcaaacuggauucacaaccacuaaugaggcguuucgcaagguccaggacgccgugaacaacaaugcucaggcccuuagcaagcuggcaagugaauuguccaacaccuucggcgcuauuagcgccucuaucggggauauaauccagcggcucgacguucuggagcaagaugcacagauugacagacuaaucaauggaaggcugacaacgcucaacgccuucguggcucagcagcugguccgcucagaguccgcggcccuuagugcacaauuggcuaaagauaaggugaaugaaugcguuaaagcccagagcaagcgaucgggcuuuuguggucaggggacccacauugugucuuucgucguaaacgccccuaauggacuguauuuuaugcaugugggcuacuaucccuccaaccacaucgagguugugagcgcuuacgguuuaugcgacgcagccaauccaacuaacuguauagcgcccgucaauggcuacuucauuaaaacaaacaauacccggaucguggacgaauggucauauacagggaguucuuuuuacgcuccugagccaaucacuucccucaacaccaaguauguagcaccccaggugacguaccaaaauauuagcacaaaccugccuccgccacuucugggaaacucaaccggcaucgauuuccaggacgagcuagaugaauuuuucaagaaugucaguacuagcauucccaacuuugggucccucacccagauaaauacaacucuguuggaccugaccuaugagauguuaucucuccaacagguugugaaagcccugaacgaaagcuacaucgaucuuaaggagcugggaaauuauacauacuacaacaaauggccuugguauauuugguugggcuucaucgccggucucguggcucuggcacuaugcgucuuuuucauucuguguugcacgggguguggaaccaauugcaugggcaaacuuaagugcaaccguuguugcgacagauacgaagaguaugaucucgagccacauaaggugcacguucacuga

SEQ ID NO: 622 - RNA, 4062 nt, Artificial Sequence
  derived and/or modified CDS sequence (opt3) from MERS-CoV__AHI48550__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaguucgcgaaugauacaaaaaucgcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaagacacaugcaacgcuguuuggcuccguggccugugaacacaucucuagcaccaugucccaguacucacggagcacucgaaguaugcucaaacgcagagacucuacauauggaccccugcagaccccugucggcugcguucuugggcugguaaauuccagcuuguucguggaggauuguaagcucccacugggacaaucguuaugcgcucugcccgacacaccuucaacucuaaccccaaggucugugcggaguguccccggugaaaugcgccucgccuccaucgcauuuaaccacccgauucagguggaucagcugaauagcucuuacuucaaacuuagcauaccuacgaacuuuuccuucggcguuacccaagaguauauccagacaacuauucagaaggugaccgucgacuguaaacaguacgugugcaauggguuccaaaagugcgaacaguugcugagagaguauggacaguuuuguucaaagaucaaccaggcgcuccauggcgcuaaucugaggcaagaugacaguguucguaacuuauucgccagcgugaaaucuucccagucaaguccaauuauccccgguuuugggggcgacuucaaucugacacuuuuggagccuguaagcauauccacuggaucucggucggcacgaagcgccaucgaagaucuccuguuugacaaggucaccauugcugaucccggcuacaugcagggguacgacgauugcaugcagcaaggaccagccucagcaagagaccuaaucugugcucaguauguggccggcuacaaagugcugccuccccucauggaugucaacauggaggcggccuauacguccagucugcuugguucuauugcugggguuggauggacagcaggcuugagcuccuucgccgcuaucccauuugcccagucaauauucuacaggcugaauggugugggcauuacccaacagguauuaucugaaaaccagaagcucaucgcaaauaaauuuaaccaggcgcugggggccaugcaaacuggauucacaaccacuaaugaggcuuuucacaaggugcaggacgccgucaacaacaaugcacaggcucuuagcaagcuggccagugaauuguccaacaccuucggcgcaauuagcgccucuaucggggauauaauccagcgccucgacgugcuggagcaagaugcucagauugaccggcuaaucaauggaagacugacaacgcucaacgcguucguugcccagcagcuggugaggucagaguccgcagcucuuagugcccaauuggccaaagauaaggucaaugaaugcgugaaagcucagagcaagcgcucgggcuuuuguggucaggggacccauauuguuucuuucguggucaacgcaccgaauggacuguauuuuaugcacguaggcuacuauccuuccaaccauaucgaggugguuagcgccuacgguuuaugcgacgcggcuaaucccacuaacuguauagccccagugaauggcuacuucauuaaaacaaacaauacccgaaucgucgacgaauggucauauacagggaguucuuuuuacgcacccgagccuaucacuucccucaacaccaaguauguggccccacagguaacguaccaaaauauuagcacaaaccugcccccuccgcuucugggaaacucaaccggcaucgauuuccaggacgagcuagaugaauuuuucaagaaugugaguacuagcauuccaaacuuugggucccucacccagauaaauacaacucuguuggaccugaccuaugagauguuaucucuccaacaggucguuaaagcucugaacgaaagcuacaucgaucuuaaggagcugggaaauuauacauacuacaacaaauggcccugguauauuugguugggcuucaucgcaggucucguggcccuggcgcuaugcguguuuuucauucuguguugcacgggguguggaaccaauugcaugggcaaacuuaagugcaaccgguguugcgaccguuacgaagaguaugaucuccagccucacaagguccacgugcauuga

SEQ ID NO: 623 - RNA, 4062 nt, Artificial Sequence
  derived and/or modified CDS sequence (opt3) from MERS-CoV__AHI48583__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacguguucaaggcugaugggauuaucuauccccagggaaggaccuacaguaacauuacaaucacuuaucaggguuuguuuccuuaccagggcgaccauggggauauguaugucuacagcgcaggacacgccaccggcacaaccccacaaaaauuauucguggcgaauuauucccaggacguuaagcaguuugcuaacgguuucgugguccggauaggggccgcagccaauucuacuggaacagugaucauuucgcccucaaccagcgcuacgauccgcaaaauuuacccugcauuuaugcugggcaguuccguaggcaacuucucugaugggaagaugggacgauuuuucaaucauacucuaguucuccugccagacgguuguggcacccuucugcgugccuuuuacugcaucuuggagcccagaagcgggaaccacuguccugcuggaaauuccuauacaucauucgccacuuaccauaccccagcgacagauugcagugacggcaacuauaauaggaacgcaagccucaauucuuucaaggaauacuuuaaccugcggaauuguaccuucauguauacguacaacauaacugaggaugaaauucuggagugguuugguaucacacagaccgcccaaggggugcaccucuucuccucacgcuaugucgacuuauacggaggcaauauguuucaguucgcuacucugccgguguacgacacaauuaaauauuacagcaucaucccccacaguauuagaucuauacaguccgauaggaaggccugggcagcuuuuuauguguacaaacuucagccuuugaccuuccugcuagacuuuagcgucgauggcuauauccggcgcgccauugacugcggguucaacgaucucucgcaacugcauuguucuuacgaguccuuugacguugaaucaggaguguauaguguaagcuccuucgaggcgaagccaucugguagcguggucgaacaggccgagggcguggagugcgauuuuucaccccuucugagugggacgccuccacagguuuacaacuucaaacgauugguguucaccaauuguaacuacaaucucacaaagcuguuaucccuguuuagcgucaacgacuucacuugcucucaaaucucacccgcagcuauagccaguaauuguuauagcucccucauucuugauuacuuuucuuauccgcugucgaugaaaagcgacuuguccgugucaagugcuggaccuaucucucaguucaacuacaagcagagcuuuuccaauccaaccugccuaauccuggccacaguaccccacaaccucacuaccauuacaaagccucugaaauauucauacaucaauaagugcagcagacuucugucugaugacaggaccgaaguuccccaguuggugaacgcaaaucaauauuccccaugugucaguauugugcccagcacugucugggaggacggcgauuacuaccggaaacagcucucuccucuggaaggugggggcugguuaguggccuccggaucaacgguugcuaugacagagcagcugcagaugggcuucgggauaaccgugcaauauggaacugacaccaacaguguaugcccaaagcuagaauuugcgaaugauacaaaaaucgcaagccagcucgguaacugugucgaguacucgcuguauggcguguccgggcguggaguuuuccagaauugcaccgccgugggcguccgccagcaaagauuuguguacgacgcuuaucagaaccuuguagguuacuauucugaugacgggaacuacuacuguuugagggccugcgugagcguuccggucucagugauuuaugauaaggagacuaagacacaugcaacgcuguucggcaguguggccugugaacacaucuccucuaccaugagccaguacucccggucaacucgaagcaugcucaaacgcagagacaguacauauggaccccugcagaccccugucggcugcguucuugggcugguaaauucuuccuuguuuguggaggauuguaagcucccacugggacaaaguuuaugcgcucugcccgacacaccuucgacucuaaccccaaggucagugcggucuguccccggugaaaugcgccucgccaguaucgcauucaaccacccgauucagguggaucagcuuaauuccagcuacuuuaaacuuucuauaccuacgaacuucagcuucggcguuacccaagaguauauccagacaacuauucagaaggugaccgucgacuguaaacaguacgugugcaauggguuucaaaagugcgaacaguugcugagagaguauggacaguucuguuccaagaucaaccaggcgcuccauggcgcuaaucugaggcaagaugacucaguucguaacuuauuugccagugugaaaagcucucaguccucaccaauuauccccgguuucgggggcgacuuuaaucugacacuuuuggagccuguaaguauaagcacuggaucccggucugcacgaucggccaucgaagaucuccuguucgacaaggucaccauugcugaucccggcuacaugcagggguacgacgauugcaugcagcaaggaccagccagcgcaagagaccuaaucugugcucaguauguggccggcuacaaagugcugccuccccucauggaugucaacauggaggcggccuauacgucaucccugcuugguaguauugcugggguuggauggacagcaggcuugucuagcuuugccgcuaucccauucgcccaguccauauuuuacaggcugaauggugugggcauuacccaacagguauuaucagaaaaccagaagcucaucgcaaauaaauucaaccaggcgcugggggccaugcaaacuggauuuacaaccacuaaugaggcuuuccacaaggugcaggacgccgucaacaacaaugcacaggcucuuucuaagcuggccagcgaauugaguaacaccuucggcgcaauuuccgccagcaucggggauauaauccagcgccucgacgugcuggagcaagaugcucagauugaccggcuaaucaauggaagacugacaacgcucaacgcguuuguugcccagcagcuggugaggucugagucagcagcucuuuccgcccaauuggccaaagauaaggucaaugaaugcgugaaagcucagaguaagcgcagcggcuucuguggucaggggacccauauuguuucguuuguggucaacgcaccgaauggacuguauuucaugcacguaggcuacuauccuucuaaccauaucgaggugguuuccgccuacgguuuaugcgacgcggcuaaucccacuaacuguauagccccagugaauggcuacuuuauuaaaacaaacaauacccgaaucgucgacgaauggagcuauacagggucaaguuucuacgcacccgagccuaucacuucucucaacaccaaguauguggccccacagguaacguaccaaaauauuuccacaaaccugcccccuccgcuucugggaaacagcaccggcaucgauuuucaggacgagcuagaugaguucuuuaagaaugugucaacuagcauuccaaacuucgggagccucacccagauaaauacaacucuguuggaccugaccuaugaaauguuaucccuccaacaggucguuaaagcucugaacgaaucuuacaucgaucuuaaggagcugggaaauuauacauacuacaacaaauggcccugguauauuugguugggcuuuaucgcaggucucguggcccuggcgcuaugcguguucuuuauucuguguugcacgggguguggaaccaauugcaugggcaagcugaaaugcaaccgguguugcgaccguuacgaagaguaugaucucgagccucacaagguccacgugcauuga

SEQ ID NO: 624 - RNA, 4062 nt, Artificial Sequence
  derived and/or modified CDS sequence (opt3) from MERS-CoV__AHI48605__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaguucgcgaaugauacaaaaaucgcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaagacacaugcaacgcuguuuggcuccguggccugugaacacaucucuagcaccaugucccaguacucacggagcacucgaaguaugcucaaacgcagagacucuacauauggaccccugcagaccccugucggcugcguucuugggcugguaaauuccagcuuguucguggaggauuguaagcucccacugggacaaucguuaugcgcucugcccgacacaccuucaacucuaaccccaaggucugugcggaguguccccggugaaaugcgccucgccuccaucgcauuuaaccacccgauucagguggaucagcugaauagcucuuacuucaaacuuagcauaccuacgaacuuuuccuucggcguuacccaagaguauauccagacaacuauucagaaggugaccgucgacuguaaacaguacgugugcaauggguuccaaaagugcgaacaguugcugagagaguauggacaguuuuguucaaagaucaaccaggcgcuccauggcgcuaaucugaggcaagaugacaguguucguaacuuauucgccagcgugaaaucuucccagucaaguccaauuauccccgguuuugggggcgacuucaaucugacacuuuuggagccuguaagcauauccacuggaucucggucggcacgaagcgccaucgaagaucuccuguuugacaaggucaccauugcugaucccggcuacaugcagggguacgacgauugcaugcagcaaggaccagccucagcaagagaccuaaucugugcucaguauguggccggcuacaaagugcugccuccccucauggaugucaacauggaggcggccuauacguccagucugcuugguucuauugcugggguuggauggacagcaggcuugagcuccuucgccgcuaucccauuugcccagucaauauucuacaggcugaauggugugggcauuacccaacagguauuaucugaaaaccagaagcucaucgcaaauaaauuuaaccaggcgcugggggccaugcaaacuggauucacaaccacuaaugaggcuuuucacaaggugcaggacgccgucaacaacaaugcacaggcucuuagcaagcuggccagugaauuguccaacaccuucggcgcaauuagcgccucuaucggggauauaauccagcgccucgacgugcuggagcaagaugcucagauugaccggcuaaucaauggaagacugacaacgcucaacgcguucguugcccagcagcuggugaggucagaguccgcagcucuuagugcccaauuggccaaagauaaggucaaugaaugcgugaaagcucagagcaagcgcucgggcuuuuguggucaggggacccauauuguuucuuucguggucaacgcaccgaauggacuguauuuuaugcacguaggcuacuauccuuccaaccauaucgaggugguuagcgccuacgguuuaugcgacgcggcuaaucccacuaacuguauagccccagugaauggcuacuucauuaaaacaaacaauacccgaaucgucgacgaauggucauauacagggaguucuuuuuacgcacccgagccuaucacuucccucaacaccaaguauguggccccacagguaacguaccaaaauauuagcacaaaccugcccccuccgcuucugggaaacucaaccggcaucgauuuccaggacgagcuagaugaauuuuucaagaaugugaguacuagcauuccaaacuuugggucccucacccagauaaauacaacucuguuggaccugaccuaugagauguuaucucuccaacaggucguuaaagcucugaacgaaagcuacaucgaucuuaaggagcugggaaauuauacauacuacaacaaauggcccugguauauuugguugggcuucaucgcaggucucguggcccuggcgcuaugcguguuuuucauucuguguugcacgggguguggaaccaauugcaugggcaaacuuaagugcaaccgguguugcgaccguuacgaagaguaugaucucgagccucacaagguccacgugcauuga

SEQ ID NO: 625 - RNA, 4062 nt, Artificial Sequence
  derived and/or modified CDS sequence (opt3) from MERS-CoV__AHY21469__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccgugacaaccccacaaaaauuauuuguugcgaauuauucucaggacgugaagcaguucgcuaacggcuuugucgugcggauaggugccgcagccaauucgacugggacaguaaucauuucacccagcaccagugcuacgauccgcaaaauuuacccugcauucaugcugggauccucuguuggcaacuuuagcgauggcaagauggggcgauucuuuaaucauacucuagugcuccugccagacggaugugguacccuucugcgugccuucuacugcaucuuggagcccagauccggcaacuauuguccugcuggcaauucauacacaaguuuugccacuuaucacaccccagcgacagauugcagcgacggaaacuacaauaggaacgcaucucucaauuccuucaaggaauauuucaaccugcggaauuguaccuuuauguacacguauaacauaacugaggaugaaauucuggagugguucggcaucacacagaccgcccaagguguccaucucuuuucaagccgcuacguggacuuauacgggggaaauauguuccaguuugcuacucugccgguguaugacacaauuaaauacuauaguaucaucccccacucuauucuuuccauacagagcgauagaaaggccugggcagcuuucuacgucuauaaauugcagccucugaccuuucuacucgacuucucgguugauggcuacaucaggcgggccauugacugcggcuuuaacgaucugucucaacuucacuguuccuaugagucauucgacguggaaagugggguauacagcguguccucuuuugaggcgaagccaagcggaucagucguggaacaggccgaggguguugagugcgauuucaguccccuguuguccggcacgccuccacagguguacaacuuuaaacgccucgucuucaccaauuguaacuauaaucugacaaaguuacugagccucuucucugugaacgacuuuacuugcucacaaaucagucccgcagcuauagccagcaauuguuacuccucucuuauucuggauuauuucucguacccguugagcaugaaguccgaccuaucaguaaguucugcugggccuaucagccaguuuaacuauaaacaguccuucucaaauccaaccugccugauccucgccacaguuccccauaaccugacuaccauuacaaagccucuuaaauacagcuauaucaauaagugcucucgacuguuguccgaugacagaaccgaagugccccagcucgucaacgcaaaucaauacaguccaugugugagcauuguccccucuacugugugggaggacggagauuacuauaggaaacagcuguccccuuuagaaggcgguggguggcugguugccucaggcaguacgguggcuaugacagagcagcuacagaugggauuuggcauaaccguacaauacgggacugacaccaacagcgucugcccaaagcucgaguucgcgaaugauacaaaaaucgcaucgcagcugggaaacuguguggaauauucccuuuacgguguuucuggccgugggguguuucagaauugcaccgccgucggagugcggcagcaacgcuucguauaugacgcuuaccagaacuuggugggcuauuacagcgaugacgguaacuacuauugucugagagccugcguuucagucccggugagugugauuuacgauaaggagacuaagacacacgcaacgcucuuuggguccgucgccugugaacauaucucuagcaccaugucccaguauucaaggagcacucggaguaugcugaaacgacgcgacucuacauacggcccccuucagaccccuguuggaugcgugcugggcuugguaaauuccagccucuucguggaggauuguaagcugccauuagggcaaucgcugugcgcucuacccgacacaccuucaacucucaccccaagaucugucaggagugugcccggagaaaugcggcuggccuccaucgcauuuaaccacccgauucagguugaucagcuuaauagcucuuauuucaaauugagcauaccuacgaacuuuuccuucggugugacccaagaguacauccagacaacuauucagaaggucaccguggacuguaaacaguauguuugcaauggcuuccaaaagugcgaacagcugcuccgcgaguacgggcaguuuuguucaaagaucaaccaggcgcugcacggagcuaauuuaagacaagaugacagugugaggaaccuguucgccagcguaaaaucuucccagucaaguccaauuauccccggcuuugguggggacuucaaucuuacauugcucgagccugucagcacuuccaccggcucucguucggcacggagcgccauagaagaucugcuauuugacaaggugacgaucgcugaucccggauacaugcagggcuaugacgauugcaugcagcaagggccagccucagcacgagaccugauuugugcucaguacguggccggauauaaaguccucccuccccugauggauguuaacauggaggcggccuacacauccagucuuuugggcucuaucgcuggugugggguggaccgcaggacugagcuccuucgccgcuauuccauuugcccagucaaucuucuauagauuaaauggcguagguauaacucaacaggugcucucugaaaaccagaagcugauugcaaauaaauuuaaccaggcgcuuggcgccaugcaaacaggguucaccacuaccaaugaggcuuuucagaagguccaggacgccgugaacaacaaugcacaggcucugagcaaguuggccagugaacucuccaacacauucggagcaaucagcgccucuauuggcgauaucauacaaaggcuggacguucuagagcaggaugcucagaucgaccgccugauuaaugggcggcucacgacccugaacgcguucguggcccagcaacuugucagaucagaguccgcagcuuugagugcccagcuggccaaagauaaggugaaugaaugcguuaaagcucagagcaagaggucgggauuuuguggccaggguacucauaucgugucuuucgucguaaacgcaccgaauggguuauacuuuaugcacgugggauauuacccuuccaaccauauugagguugugagcgccuacggccucugcgacucagcgaaucccacaaacuguaucgcuccagucaaugguuauuucauaaaaaccaacaauacacgcauuguggacgaauggaguuacacugggucuuccuuuuaugcccccgagccuaucaccagccugaacacgaaguacguagcaccacaagugacauaucagaauaucucaaccaaccuucccccuccgcugcuagggaacaguacuggaauugauuuccaggacgagcucgaugaauuuuucaagaaugucagcaccuccaucccaaacuuuggcucucugacacaaauuaauacuaccuugcuggacuuaacauacgagaugcucagccugcagcagguugugaaagcccuuaacgaauccuauauagaucugaaggaguuggggaauuacacguacuauaacaaauggcccugguacaucuggcucggauucauugcuggccugguggcacuagcccugugcgucuuuuucauccuuuguugcaccgguugugggacuaauugcaugggaaagcucaaaugcaaccgauguugcgaccgguaugaagaguacgaucuggagccucacaaggugcauguucacuga

SEQ ID NO: 626 - RNA, 4062 nt, Artificial Sequence
  derived and/or modified CDS sequence (opt3) from MERS-CoV__AHZ64057__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaguucgcgaaugauacaaaaaucgcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaagacacaugcaacgcuguuuggcuccguggccugugaacacaucuucucuaccaugagccaguacucccggucaacucgaagcaugcucaaacgcagagacaguacauauggaccccugcagaccccugucggcugcguucuugggcugguaaauucuuccuuguuuguggaggauuguaagcucccacugggacaaaguuuaugcgcucugcccgacacaccuucgacucuaaccccaaggucagugcggucuguccccggugaaaugcgccucgccaguaucgcauucaaccacccgauucagguggaucagcuuaauuccagcuacuuuaaacuuucuauaccuacgaacuucagcuucggcguuacccaagaguauauccagacaacuauucagaaggugaccgucgacuguaaacaguacgugugcaauggguuucaaaagugcgaacaguugcugagagaguauggacaguucuguuccaagaucaacagggcgcuccauggcgcuaaucugcgucaggaugacucaguucggaacuuauuugccagugugaaaagcucucaauccucaccaauuauccccgguuucgggggcgacuuuaaucugacacuuuuggagccuguaaguauaagcacuggaucccgaucugcaagaucggccaucgaagaucuccuguucgacaaggucaccauugcugaucccggcuacaugcagggguacgacgauugcaugcagcagggaccagccagcgcaagggaccuaaucugugcucaauauguggccggcuacaaagugcugccuccccucauggaugucaacauggaggcggccuauacgucaucccugcuugguaguauugcugggguuggauggacagcaggcuugucuagcuuugccgcuaucccauucgcccaguccauauuuuaccgccugaauggugugggcauuacccagcaaguauuaucagaaaaccagaagcucaucgcaaauaaauucaaccaggcgcugggggccaugcagacuggauuuacaaccacuaaugaggcuuuccggaaggugcaagacgccgucaacaacaaugcacaggcucuuucuaagcuggccagcgaauugaguaacaccuucggcgcaauuuccgccagcaucggggauauaauccagagacucgacgugcuggagcaggaugcucaaauugacaggcuaaucaauggacgccugacaacgcucaacgcguuuguugcccagcagcuggugcgaucugagucagcagcucuuuccgcccaguuggccaaagauaaggucaaugaaugcgugaaagcucaaaguaagcggagcggcuucuguggucaggggacccacauuguuucguuuguggucaacgcaccgaauggacuguauuucaugcauguaggcuacuauccuucuaaccacaucgaggugguuuccgccuacgguuuaugcgacgcggcuaaucccacuaacuguauagccccagugaauggcuacuuuauuaaaacaaacaauacccguaucgucgacgaauggagcuauacagggucaaguuucuacgcacccgagccuaucacuucucucaacaccaaguauguggccccacagguaacguaccagaauauuuccacaaaccugcccccuccgcuucugggaaacagcaccggcaucgauuuucaagacgagcuagaugaguucuuuaagaaugugucaacuagcauuccaaacuucgggagccucacccagauaaauacaacucuguuggaccugaccuaugaaauguuaucccuccagcaagucguuaaagcucugaacgaaucuuacaucgaucuuaaggagcugggaaauuauacauacuacaacaaauggcccugguauauuugguugggcuuuaucgcaggucucguggcccuggcgcuaugcguguucuuuauucuguguugcacgggguguggaaccaauugcaugggcaagcugaaaugcaacagauguugcgacagguacgaagaguaugaucucgagccucauaagguccacgugcacuga

SEQ ID NO: 627 - RNA, 4062 nt, Artificial Sequence
  derived and/or modified CDS sequence (opt3) from MERS-CoV__AID50418__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaguucgcgaaugauacaaaaaucgcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaagacacaugcaacgcuguuuggcuccguggccugugaacacaucucuagcaccaugucccaguacucacggagcacucgaaguaugcucaaacgcagagacucuacauauggaccccugcagaccccugucggcugcguucuugggcugguaaauuccagcuuguucguggaggauuguaagcucccacugggacaaucguuaugcgcucugcccgacacaccuucaacucuaaccccaaggucugugcggaguguccccggugaaaugcgccucgccuccaucgcauuuaaccacccgauucagguggaucagcugaauagcucuuacuucaaacuuagcauaccuacgaacuuuuccuucggcguuacccaagaguauauccagacaacuauucagaaggugaccgucgacuguaaacaguacgugugcaauggguuccaaaagugcgaacaguugcugagagaguauggacaguuuuguucaaagaucaaccaggcgcuccauggcgcuaaucugaggcaagaugacaguguucguaacuuauucgccagcgugaaaucuucccagucaaguccaauuauccccgguuuugggggcgacuucaaucugacacuuuuggagccuguaagcauauccacuggaucucggucggcacgaagcgccaucgaagaucuccuguuugacaaggucaccauugcugaucccggcuacaugcagggguacgacgauugcaugcagcaaggaccagccucagcaagagaccuaaucugugcucaguauguggccggcuacaaagugcugccuccccucauggaugucaacauggaggcggccuauacguccagucugcuugguucuauugcugggguuggauggacagcaggcuugagcuccuucgccgcuaucccauuugcccagucaauauucuacaggcugaauggugugggcauuacccaacagguauuaucugaaaaccagaagcucaucgcaaauaaauuuaaccaggcgcugggggccaugcaaacuggauucacaaccacuaaugaggcuuuucgcaaggugcaggacgccgucaacaacaaugcacaggcucuuagcaagcuggccagugaauuguccaacaccuucggcgcaauuagcgccucuaucggggauauaauccagcggcucgacgugcuggagcaagaugcucagauugacagacuaaucaauggaaggcugacaacgcucaacgcguucguugcccagcagcuggugcgcucagaguccgcagcucuuagugcccaauuggccaaagauaaggucaaugaaugcgugaaagcucagagcaagcgaucgggcuuuuguggucaggggacccacauuguuucuuucguggucaacgcaccgaauggacuguauuuuaugcauguaggcuacuauccuuccaaccacaucgaggugguuagcgccuacgguuuaugcgacgcggcuaaucccacuaacuguauagccccagugaauggcuacuucauuaaaacaaacaauacccggaucgucgacgaauggucauauacagggaguucuuuuuacgcacccgagccuaucacuucccucaacaccaaguauguggccccacagguaacguaccaaaauauuagcacaaaccugcccccuccgcuucugggaaacucaaccggcaucgauuuccaggacgagcuagaugaauuuuucaagaaugugaguacuagcauuccaaacuuugggucccucacccagauaaauacaacucuguuggaccugaccuaugagauguuaucucuccaacaggucguuaaagcucugaacgaaagcuacaucgaucuuaaggagcugggaaauuauacauacuacaacaaauggcccugguauauuugguugggcuucaucgcaggucucguggcccuggcgcuaugcguguuuuucauucuguguugcacgggguguggaaccaauugcaugggcaaacuuaagugcaaccguuguugcgacagauacgaagaguaugaucucgagccucauaagguccacgugcacuga

SEQ ID NO: 628 - RNA, 4062 nt, Artificial Sequence
  derived and/or modified CDS sequence (opt3) from MERS-CoV__AID55068__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaguucgcgaaugauacaaaaaucgcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaagacacaugcaacgcuguuuggcuccguggccugugaacacaucucuagcaccaugucccaguacucacggagcacucgaaguaugcucaaacgcagagacucuacauauggaccccugcagaccccugucggcugcguucuugggcugguaaauuccagcuuguucguggaggauuguaagcucccacugggacaaucguuaugcgcucugcccgacacaccuucaacucuaaccccaaggucugugcggaguguccccggugaaaugcgccucgccuccaucgcauuuaaccacccgauucagguggaucagcugaauagcucuuacuucaaacuuagcauaccuacgaacuuuuccuucggcguuacccaagaguauauccagacaacuauucagaaggugaccgucgacuguaaacaguacgugugcaauggguuccaaaagugcgaacaguugcugagagaguauggacaguuuuguucaaagaucaacagggcgcuccauggcgcuaaucugcgucaggaugacaguguucggaacuuauucgccagcgugaaaucuucccaaucaaguccaauuauccccgguuuugggggcgacuucaaucugacacuuuuggagccuguaagcauauccacuggaucucgaucggcaagaagcgccaucgaagaucuccuguuugacaaggucaccauugcugaucccggcuacaugcagggguacgacgauugcaugcagcagggaccagccucagcaagggaccuaaucugugcucaauauguggccggcuacaaagugcugccuccccucauggaugucaacauggaggcggccuauacguccagucugcuugguucuauugcugggguuggauggacagcaggcuugagcuccuucgccgcuaucccauuugcccagucaauauucuaccgccugaauggugugggcauuacccagcaaguauuaucugaaaaccagaagcucaucgcaaauaaauuuaaccaggcgcugggggccaugcagacuggauucacaaccacuaaugaggcuuuucggaaggugcaagacgccgucaacaacaaugcacaggcucuuagcaagcuggccagugaauuguccaacaccuucggcgcaauuagcgccucuaucggggauauaauccagagacucgacgugcuggagcaggaugcucaaauugacaggcuaaucaauggacgccugacaacgcucaacgcguucguugcccagcagcuggugcgaucagaguccgcagcucuuagugcccaguuggccaaagauaaggucaaugaaugcgugaaagcucaaagcaagcggucgggcuuuuguggucaggggacccacauuguuucuuucguggucaacgcaccgaauggacuguauuuuaugcauguaggcuacuauccuuccaaccacaucgaggugguuagcgccuacgguuuaugcgacgcggcuaaucccacuaacuguauagccccagugaauggcuacuucauuaaaacaaacaauacccguaucgucgacgaauggucauauacagggaguucuuuuuacgcacccgagccuaucacuucccucaacaccaaguauguggccccacagguaacguaccagaauauuagcacaaaccugcccccuccgcuucugggaaacucaaccggcaucgauuuccaagacgagcuagaugaauuuuucaagaaugugaguacuagcauuccaaacuuugggucccucacccagauaaauacaacucuguuggaccugaccuaugagauguuaucucuccagcaagucguuaaagcucugaacgaaagcuacaucgaucuuaaggagcugggaaauuauacauacuacaacaaauggcccugguauauuugguugggcuucaucgcaggucucguggcccuggcgcuaugcguguuuuucauucuguguugcacgggguguggaaccaauugcaugggcaaacuuaagugcaacagauguugcgacagguacgaagaguaugaucucgagccucauaagguccacgugcacuga

SEQ ID NO: 629 - RNA, 4062 nt, Artificial Sequence
  derived and/or modified CDS sequence (opt3) from MERS-CoV__AID55073__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaauuucacaaagcuccugagcuuauuuucugucaacgacuucacuugcucacaaaucagucccgcagcuauagccagcaauuguuauuccucucugauucucgauuacuuuucguauccgcuuagcaugaaguccgaccugucagugaguucugcuggaccuaucagccaguucaacuacaaacaguccuuuucaaauccaaccugcuugauccuagccacaguaccccacaaccugacuaccauuacaaagccucucaaauauagcuacaucaauaagugcucuagacugcuuuccgaugacaggaccgaaguuccccagcuggugaacgcaaaucaauauaguccaugugucagcauugugcccucuacugucugggaggacggcgauuacuaccggaaacaguuguccccucucgaaggugggggcuggcugguggccucaggaaguacgguugcuaugacagagcaguuacagaugggcuucgggauaaccgugcaauauggaacugacaccaacagcguaugcccaaagcuggaauuugcgaaugauacaaaaaucgcaucgcagcuagguaacugugucgaguacucccucuauggcgugucugggcguggaguuuuccagaauugcaccgccgugggcguccgccagcaaagauuuguguacgacgcuuaucagaaccugguagguuacuauagcgaugacgggaacuacuacugucuuagggccugcgugucaguuccggucagugugauuuaugauaaggagacuaagacacaugcaacguuguucggcuccguggccugugaacacaucucuagcaccaugucccaguacucacggagcacucgaaguaugcugaaacgcagagacucuacauauggaccccuccagaccccugucggcugcguucuggggcuuguaaauuccagccuguuuguggaggauuguaaguugccacucggacaaucgcugugcgcuuuacccgacacaccuucaacucugaccccaaggucugugcggaguguccccggugaaaugcgccuagccuccaucgcauucaaccacccgauucagguggaucagcucaauagcucuuacuuuaaacugagcauaccuacgaacuucuccuucggcguuacccaagaguauauccagacaacuauucagaaggugaccgucgacuguaaacaguacgugugcaauggguuucaaaagugcgaacagcuuuugagagaguauggacaguucuguucaaagaucaaccaggcgcugcauggcgcuaaucucaggcaagaugacaguguucguaaccuguuugccagcgugaaaucuucccagucaaguccaauuauccccgguuucgggggcgacuuuaauuuaacacugcuugagccuguaagcauauccacuggaucucggucggcacgaagcgccaucgaagaucuccucuucgacaaggucaccauugcugaucccggcuacaugcagggguacgacgauugcaugcagcaaggaccagccucagcaagagaccugaucugugcucaguauguggccggcuacaaagugcuaccuccccugauggaugucaacauggaggcggccuauacguccagucuccuggguucuauugcugggguuggauggacagcaggccuuagcuccuuugccgcuaucccauucgcccagucaauauuuuacagguugaauggugugggcauuacccaacagguacugucugaaaaccagaaguuaaucgcaaauaaauucaaccaggcgcucggggccaugcaaacuggauuuacaaccacuaaugaggcuuuccgcaaggugcaggacgccgucaacaacaaugcacaggcucugagcaaacuugccagugaacuguccaacaccuucggcgcaauuagcgccucuaucggggauauaauccagcgguuggacgugcucgagcaagaugcucagauugacagacugaucaauggaaggcuaacaacgcugaacgcguuuguugcccagcagcucgugcgcucagaguccgcagcucugagugcccaacuugccaaggauaaggucaaugaaugcgugaaagcucagagcaagcgaucgggcuucuguggucaggggacccacauuguuucuuuuguggucaacgcaccgaauggauuguauuucaugcauguaggcuacuauccuuccaaccacaucgaggugguuagcgccuacggucugugcgacgcggcuaaucccacuaacuguauagccccagugaauggcuacuuuauuaaaacaaacaauacccggaucgucgacgaauggucauauacagggaguucuuucuacgcacccgagccuaucacuuccuuaaacaccaaguauguggccccacagguaacguaccaaaauauuagcacaaacuugcccccuccgcugcuuggaaacucaaccggcaucgauuuucaggacgagcuggaugaguucuuuaagaaugugaguacuagcauuccaaacuucgggucccuaacccagauaaauacaacucuccuggacuugaccuaugaaaugcugucuuuacaacaggucguuaaagcucucaacgaaagcuacaucgaucugaaggagcuuggaaauuauacauacuacaacaaauggcccugguauauuuggcugggcuuuaucgcagguuugguggcccucgcgcugugcguguucuuuauucuauguugcacgggguguggaaccaauugcaugggcaagcugaaaugcaaccguuguugcgacagauacgaagaguaugaucuugagccucauaagguccacgugcacuga

SEQ ID NO: 630 - RNA, 4062 nt, Artificial Sequence
  derived and/or modified CDS sequence (opt3) from MERS-CoV__AIY60528__S
augauccacagcguguuccugcucauguuucuucugacccccacagaguccuacgucgacguuggcccugauucuuucaagucagccugcauugaaguggacauacagcaaaccuuuuucgauaaaacguggccaagaccgaucgacguaaguaaggcugaugggauuaucuauccccagggaaggaccuacagcaacauuacaaucacuuaucaggguuuguuuccuuaccagggcgaccauggggauauguauguguacuccgcaggacacgccaccggcacaaccccacaaaaauuauucgucgcgaauuauucucagaacgugaagcaguuugcuaaugguuucguugugcggauaggggccgcagccaacucgacuggaacagucaucauuucacccagcaccagugcuacgauccgcaaaauuuacccugcauuuaugcugggcuccucugugggcaauuucagcgacgggaagaugggacgauuuuucaaccauacucuaguacuccugccagaugguuguggcacccuucugcgugccuuuuacugcaucuuggagcccagauccgggaaucacuguccugcuggaaacucauauacaaguuucgccacuuaccauaccccagcgacagacugcagcgauggcaauuauaacaggaaugcaucucucaacuccuucaaggaauacuuuaaucugcggaacuguaccuucauguauacguacaauauaacugaggacgaaauucuggagugguuugguaucacacagaccgcccaagggguucaccucuucucaagccgcuauguggauuuauacggaggcaacauguuucaguucgcuacucugccggucuacgacacaauuaaauauuacaguaucaucccccacucuauuagauccauacagagcgacaggaaggccugggcagcuuuuuauguguacaaacuucagccuuugaccuuccugcuagauuuuucgguggacggcuauauccggcgcgccauugauugcggguucaacgaccucucucaacugcauuguuccuacgagucauuugaugucgaaaguggaguuuauagcguguccucuuucgaggcgaagccaagcgguucaguaguggaacaggccgagggcgucgagugcgacuuuaguccccuucuguccgggacgccuccacagguguacaauuucaaacgauugguuuucaccaacuguaauuacaaccucacaaagcuguuaagccuguuuucugugaaugauuucacuugcucacaaaucagucccgcagcuauagccagcaacuguuauuccucucucauucuugacuacuuuucguauccgcugagcaugaaguccgauuugucagucaguucugcuggaccuaucagccaguucaauuacaaacaguccuuuucaaaccccacuugccuaauccuggccacagugccacacaaucucacuaccauuacaaagccucugaaauauagcuacaucaacaagugcucuagacuucuguccgacgauaggaccgaaguaccccaguugguuaaugcaaaccaauauaguccaugugugagcauuguccccucuacugugugggaggacggcgacuacuaccggaaacagcucuccccucuggaaggugggggcugguuagucgccucaggaaguacgguggcuaugacagagcagcugcagaugggcuucgggauaaccguucaauauggaacugauaccaauagcgugugcccaaagcuagaauuugcgaacgacacaaaaaucgcaucgcagcucgguaauuguguagaguacucccuguauggcgucucugggcguggaguguuccagaacugcaccgccguuggcgugcgccagcaaagauuugucuacgaugcuuaucagaaccuuguggguuacuauagcgacgaugggaauuacuacuguuugagggccugcguaucagugccgguuagugucauuuaugacaaggagacuaagacacaugcaacgcuguucggcuccguggccugugaacacaucucuagcaccaugucccaguacucacggagcacucgaaguaugcucaaacgcagagauucuacauauggaccccugcagaccccugugggcugcguccuugggcugguuaacuccagcuuguuuguggaggacuguaagcucccacugggacaaucguuaugcgcucugcccgauacaccuucaacucuaaccccaaggucugugcggaguguacccggugaaaugcgccucgccuccaucgcauucaaucacccgauucaggucgaccagcugaacagcucuuacuuuaaacuuagcauaccuacgaauuucuccuucggcgugacccaagaguauauccagacaacuauucagaagguuaccguggauuguaaacaguacgucugcaacggguuucaaaagugcgaacaguugcugagagaguauggacaguucuguucaaagaucaaucaggcgcuccauggcgcuaaccugaggcaagacgauagugugcguaauuuauuugccagcguuaaaucuucccagucaaguccaauuauccccgguuucgggggcgacuuuaaccugacacuuuuggagccugugagcauauccacuggaucucggucggcacgaagcgccaucgaagaccuccuguucgauaagguaaccauugcugaccccggcuacaugcagggguacgaugacugcaugcagcaaggaccagccucagcaagagaucuaaucugugcucaguaugucgccggcuacaaagugcugccuccccucauggacgugaauauggaggcggccuauacguccagucugcuugguucuauugcuggggucggauggacagcaggcuugagcuccuuugccgcuaucccauucgcccagucaauauuuuacaggcugaacgguguuggcauuacccaacagguguuaucugaaaaucagaagcucaucgcaaacaaauucaaucaggcgcugggggccaugcaaacuggauuuacaaccacuaacgaggcuuuccgcaagguacaggaugccgugaacaauaacgcacaggcucuuagcaagcuggccagugaauuguccaauaccuucggcgcaauuagcgccucuaucggggacauaauccagcggcucgauguccuggagcaagacgcucagauugauagacuaaucaacggaaggcugacaacgcucaaugcguuuguggcccagcagcugguucgcucagaguccgcagcucuuagugcccaauuggccaaagacaaggugaacgaaugcgucaaagcucagagcaagcgaucgggcuucuguggucaggggacccacauugugucuuuuguugugaaugcaccgaacggacuguauuucaugcaugucggcuacuauccuuccaaucacaucgagguagugagcgccuacgguuuaugcgaugcggcuaaccccacuaauuguauagccccaguuaacggcuacuuuauuaaaacaaauaacacccggaucguggacgaauggucauauacagggaguucuuucuacucccccgagccuaucacuagccucaauaccaaguaugucgcaccacaggugacguaccaaaacauuucaacaaaccugcccccuccgcuucugggaaauaguaccggcaucgacuuucaggaugagcuagacgaguucuuuaagaacguaagcacuuccauuccaaauuucgggucucucacccagauaaacacaacucuguuggaucugaccuaugaaauguuaagccuccaacagguggucaaagcccugaaugaauccuacaucgaccuuaaggagcugggaaacuauacauacuacaauaaauggcccugguauauuugguugggcuuuaucgcuggucucguugcacuggcccuaugcguguucuuuauucuguguugcacgggguguggaaccaacugcaugggcaaacuuaagugcaaucguuguugcgauagauacgaagaguaugaccucgagccucauaaggugcacguccacuga

SEQ ID NO: 631 - RNA, 4062 nt, Artificial Sequence
  derived and/or modified CDS sequence (opt3) from MERS-CoV__AIY60558__S
augauccacagcguguuccugcucauguuucuucugacccccacagaguccuacgucgacguuggcccugauucuuucaagucagccugcauugaaguggacauacagcaaaccuuuuucgauaaaacguggccaagaccgaucgacguaaguaaggcugaugggauuaucuauccccagggaaggaccuacagcaacauuacaaucacuuaucaggguuuguuuccuuaccagggcgaccauggggauauguauguguacuccgcaggacacgccaccggcacaaccccacaaaaauuauucgucgcgaauuauucucaggacgugaagcaguuugcuaacgguuucguugugcggauaggggccgcagccaauucgacuggaacagucaucauuucacccagcaccagugcuacgauccgcaaaauuuacccugcauuuaugcugggcuccucugugggcaacuucagcgaugggaagaugggacgauuuuucaaucauacucuaguacuccugccagacgguuguggcacccuucugcgugccuuuuacugcaucuuggagcccagauccgggaaccacuguccugcuggaaauucauauacaaguuucgccacuuaccauaccccagcgacagauugcagcgacggcaacuauaauaggaacgcaucucucaauuccuucaaggaauacuuuaaccugcggaauuguaccuucauguauacguacaacauaacugaggaugaaauucuggagugguuugguaucacacagaccgcccaagggguucaccucuucucaagccgcuauguggacuuauacggaggcaauauguuucaguucgcuacucugccggucuacgacacaauuaaauauuacaguaucaucccccacucuauuagauccauacagagcgauaggaaggccugggcagcuuuuuauguguacaaacuucagccuuugaccuuccugcuagacuuuucgguggauggcuauauccggcgcgccauugacugcggguucaacgaucucucucaacugcauuguuccuacgagucauuugacgucgaaaguggaguuuauagcguguccucuuucgaggcgaagccaagcgguucaguaguggaacaggccgagggcgucgagugcgauuuuaguccccuucuguccgggacgccuccacagguguacaacuucaaacgauugguuuucaccaauuguaacuacaaucucacaaagcuguuaagccuguuuucugugaacgacuucacuugcucacaaaucagucccgcagcuauagccagcaauuguuauuccucucucauucuugauuacuuuucguauccgcugagcaugaaguccgacuugucagucaguucugcuggaccuaucagccaguucaacuacaaacaguccuuuucaaaucccacuugccuaauccuggccacagugccacacaaccucacuaccauuacaaagccucugaaauauagcuacaucaauaagugcucuagacuucuguccgaugacaggaccgaaguaccccaguugguuaacgcaaaucaauauaguccaugugugagcauuguccccucuacugugugggaggacggcgauuacuaccggaaacagcucuccccucuggaaggugggggcugguuagucgccucaggaaguacgguggcuaugacagagcagcugcagaugggcuucgggauaaccguucaauauggaacugacaccaacagcgugugcccaaagcuagaauuugcgaaugauacaaaaaucgcaucgcagcucgguaacuguguagaguacucccuguauggcgucucugggcguggaguguuccagaauugcaccgccguuggcgugcgccagcaaagauuugucuacgacgcuuaucagaaccuuguggguuacuauagcgaugacgggaacuacuacuguuugagggccugcguaucagugccgguuagugucauuuaugauaaggagacuaagacacaugcaacgcuguucggcuccguggccugugaacacaucucuagcaccaugucccaguacucacggagcacucgaaguaugcucaaacgcagagacucuacauauggaccccugcagaccccugugggcugcguccuugggcugguuaauuccagcuuguuuguggaggauuguaagcucccacugggacaaucguuaugcgcucugcccgacacaccuucaacucuaaccccaaggucugugcggaguguacccggugaaaugcgccucgccuccaucgcauucaaccacccgauucaggucgaucagcugaauagcucuuacuuuaaacuuagcauaccuacgaacuucuccuucggcgugacccaagaguauauccagacaacuauucagaagguuaccguggacuguaaacaguacgucugcaauggguuucaaaagugcgaacaguugcugagagaguauggacaguucuguucaaagaucaaccaggcgcuccauggcgcuaaucugaggcaagaugacagugugcguaacuuauuugccagcguuaaaucuucccagucaaguccaauuauccccgguuucgggggcgacuuuaaucugacacuuuuggagccugugagcauauccacuggaucucggucggcacgaagcgccaucgaagaucuccuguucgacaagguaaccauugcugaucccggcuacaugcagggguacgacgauugcaugcagcaaggaccagccucagcaagagaccuaaucugugcucaguaugucgccggcuacaaagugcugccuccccucauggaugugaacauggaggcggccuauacguccagucugcuugguucuauugcuggggucggauggacagcaggcuugagcuccuuugccgcuaucccauucgcccagucaauauuuuacaggcugaaugguguuggcauuacccaacagguguuaucugaaaaccagaagcucaucgcaaauaaauucaaccaggcgcugggggccaugcaaacuggauuuacaaccacuaaugaggcuuuccgcaagguacaggacgccgugaacaacaaugcacaggcucuuagcaagcuggccagugaauuguccaacaccuucggcgcaauuagcgccucuaucggggauauaauccagcggcucgacguccuggagcaagaugcucagauugacagacuaaucaauggaaggcugacaacgcucaacgcguuuguggcccagcagcugguucgcucagaguccgcagcucuuagugcccaauuggccaaagauaaggugaaugaaugcgucaaagcucagagcaagcgaucgggcuucuguggucaggggacccacauugugucuuuuguugugaacgcaccgaauggacuguauuucaugcaugucggcuacuauccuuccaaccacaucgagguagugagcgccuacgguuuaugcgacgcggcuaaucccacuaacuguauagccccaguuaauggcuacuuuauuaaaacaaacaauacccggaucguggacgaauggucauauacagggaguucuuucuacucccccgagccuaucacuagccucaacaccaaguaugucgcaccacaggugacguaccaaaauauuucaacaaaccugcccccuccgcuucugggaaacaguaccggcaucgauuuucaggacgagcuagaugaguucuuuaagaauguaagcacuuccauuccaaacuucgggucucucacccagauaaauacaacucuguuggaccugaccuaugaaauguuaagccuccaacagguggucaaagcccugaacgaauccuacaucgaucuuaaggagcugggaaauuauacauacuacaacaaauggcccugguauauuugguugggcuuuaucgcuggucucguugcacuggcccuaugcguguucuuuauucuguguugcacgggguguggaaccaauugcaugggcaaacuuaagugcaaccguuguugcgacagauacgaagaguaugaucucgagccucauaaggugcacguccacuga

SEQ ID NO: 632 - RNA, 4062 nt, Artificial Sequence
  derived and/or modified CDS sequence (opt3) from MERS-CoV__AIZ74450__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaguucgcgaaugauacaaaaaucgcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaagacacaugcaacgcuguuuggcuccguggccugugaacacaucucuagcaccaugucccaguacucacggagcacucgaaguaugcucaaacgcagagacucuacauauggaccccugcagaccccugucggcugcguucuugggcugguaaauuccagcuuguucguggaggauuguaagcucccacugggacaaucguuaugcgcucugcccgacacaccuucaacucuaaccccaaggucugugcggaguguccccggugaaaugcgccucgccuccaucgcauuuaaccacccgauucagguggaucagcugaauagcucuuacuucaaacuuagcauaccuacgaacuuuuccuucggcguuacccaagaguauauccagacaacuauucagaaggugaccgucgacuguaaacaguacgugugcaauggguuccaaaagugcgaacaguugcugagagaguauggacaguuuuguucaaagaucaaccaggcgcuccauggcgcuaaucugaggcaagaugacaguguucguaacuuauucgccagcgugaaaucuucccagucaaguccaauuauccccgguuuugggggcgacuucaaucugacacuuuuggagccuguaagcauauccacuggaucucggucggcacgaagcgccaucgaagaucuccuguuugacaaggucaccauugcugaucccggcuacaugcagggguacgacgauugcaugcaccagggaccagccucagcaagagaccuaaucugugcucaauauguggccggcuacaaagugcugccuccccucauggaugucaacauggaggcggccuauacguccagucugcuugguucuauugcugggguuggauggacagcaggcuugagcuccuucgccgcuaucccauuugcccagucaauauucuacaggcugaauggugugggcauuacccagcaaguauuaucugaaaaccagaagcucaucgcaaauaaauuuaaccaggcgcugggggccaugcagacuggauucacaaccacuaaugaggcuuuucgcaaggugcaagacgccgucaacaacaaugcacaggcucuuagcaagcuggccagugaauuguccaacaccuucggcgcaauuagcgccucuaucggggauauaauccagcggcucgacgugcuggagcaggaugcucaaauugacagacuaaucaauggaaggcugacaacgcucaacgcguucguugcccagcagcuggugcgcucagaguccgcagcucuuagugcccaguuggccaaagauaaggucaaugaaugcgugaaagcucaaagcaagcgaucgggcuuuuguggucaggggacccauauuguuucuuucguggucaacgcaccgaauggacuguauuuuaugcacguaggcuacuauccuuccaaccauaucgaggugguuagcgccuacgguuuaugcgacgcggcuaaucccacuaacuguauagccccagugaauggcuacuucauuaaaacaaacaauacccggaucgucgacgaauggucauauacagggaguucuuuuuacucccccgagccuaucacuagccucaacaccaaguauguggcaccacagguaacguaccagaauauuucaacaaaccugcccccuccgcuucugggaaacaguaccggcaucgauuuccaagacgagcuagaugaauuuuucaagaaugugagcacuuccauuccaaacuuugggucucucacccagauaaauacaacucuguuggaccugaccuaugagauguuaagccuccagcaagucguuaaagcccugaacgaauccuacaucgaucuuaaggagcugggaaauuauacauacuacaacaaauggcccugguauauuugguugggcuucaucgcuggucucguggcacuggcccuaugcguguuuuucauucuguguugcacgggguguggaaccaauugcaugggcaaacuuaagugcaaccguuguugcgacagauacgaagaguaugaucucgagccucacaagguccacgugcauuga

SEQ ID NO: 633 - RNA, 4062 nt, Artificial Sequence
  derived and/or modified CDS sequence (opt3) from MERS-CoV__AJD81440__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuaaccccucaaccagcgcuacgauccgcaaaauuuacccugcauucaugcugggcaguuccguaggcaauuuuucugaugggaagaugggacgauucuuuaaccauacucuaguucuccugccagacgguuguggcacccuucugcgugccuucuacugcaucuuggagcccagaagcgggaaucacuguccugcuggaaacuccuauacaucauuugccacuuaccauaccccagcgacagauugcagugacggcaauuauaacaggaaugcaagccucaacucuuucaaggaauacuucaaucugcggaacuguaccuuuauguauacguacaauauaacugaggaugaaauucuggagugguucgguaucacacagaccgcccaaggggugcaccucuuuuccucacgcuaugucgacuuauacggaggcaacauguuccaguuugcuacucugccgguguacgacacaauuaaauauuacagcaucaucccccacaguauuagaucuauacaguccgauaggaaggccugggcagcuuucuauguguacaaacuucagccuuugaccuuucugcuagacuucagcgucgauggcuauauccggcgcgccauugacugcggguuuaacgaucucucgcaacugcauuguucuuacgaguccuucgacguugaaucaggaguguauaguguaagcuccuuugaggcgaagccaucugguagcguggucgaacaggccgagggcguggagugcgauuucucaccccuucugagugggacgccuccacagguuuacaauuuuaaacgauugguguucaccaacuguaauuacaaccucacaaagcuguuaucccuguucagcgucaaugacuuuacuugcucucaaaucucacccgcagcuauagccaguaacuguuauagcucccucauucuugauuacuucucuuauccgcugucgaugaagagugacuuguccgugucaagugcuggaccuaucucucaguuuaauuacaaacagagcuucuccaacccaaccugccuaauccuggccacaguaccccacaaucucacuaccauuacaaagccucugaaauauucauacaucaacaagugcagcagacuucugucugaugacaggaccgaaguuccccaguuggugaaugcaaaccaauauuccccaugugucaguauugugcccagcacugucugggaggacggcgauuacuaccggaaacagcucucuccucuggaaggugggggcugguuaguggccuccggaucaacgguugcuaugacagagcagcugcagaugggcuuugggauaaccgugcaauauggaacugacaccaauaguguaugcccaaagcuagaguucgcgaacgauacaaaaaucgcaagccagcucgguaauugugucgaauacucgcuguauggcguguccgggcguggaguuuuucagaacugcaccgccgugggcguccgccagcaaagauucguguacgacgcuuaucagaaccuuguagguuacuauucugaugacgggaauuacuacuguuugagggccugcgugagcguuccggucucagugauuuaugauaaggagacuaagacacaugcaacgcuguuuggcaguguggccugugaacacaucuccucuaccaugagccaguacucccggucaacucgaagcaugcucaaacgcagagacaguacauauggaccccugcagaccccugucggcugcguucuugggcuggugaacucuuccuuguucguggaggauuguaagcucccacugggacaaagccuuugcgcucugcccgacacaccuucgacucuaaccccaaggucaguacggucuguccccggugaaaugcgccucgccaguaucgcauuuaaucacccgauucagguggaucagcugaacuccagcuacuucaaacuuucuauaccuacgaauuuuagcuucggcguuacccaagaguauauccagacaacuauucagaaggugaccgucgacuguaaacaguacgugugcaacggguuccaaaagugcgaacaguugcugagagaguauggacaguuuuguuccaagaucaaucaggcgcuccauggcgcuaaccugaggcaagaugacucaguucguaauuuauucgccagugugaaaagcucucaguccucaccaauuauccccgguuuugggggcgacuucaaccugacacuuuuggagccuguaaguauaagcacuggaucccggucugcacgaucggccaucgaagaucuccuguuugacaaggucaccauugcugaucccggcuacaugcagggguacgacgauugcaugcagcaaggaccagccagcgcaagagaccuaaucugugcucaguauguggccggcuacaaagugcugccuccccucauggaugucaauauggaggcggccuauacgucaucccugcuugguaguauugcugggguuggauggacagcaggcuugucuagcuucgccgcuaucccauuugcccaguccauauucuacaggcugaacggugugggcauuacccaacagguauuaucagaaaaucagaagcucaucgcaaacaaauuuaaucaggcgcugggggccaugcaaacuggauucacaaccacuaacgaggcuuuucgcaaggugcaggacgccgucaacaauaacgcacaggcucuuucuaagcuggccagcgaauugaguaauaccuucggcgcaauuuccgccagcaucggggauauaauccagcggcucgacgugcuggagcaagaugcucagauugacagacuaaucaacggaaggcugacaacgcucaaugcguucguugcccagcagcuggugcgcucugagucagcagcucuuuccgcccaauuggccaaagauaaggucaacgaaugcgugaaagcucagaguaagcgaagcggcuuuuguggucaggggacccacauuguuucguucguggucaaugcaccgaacggacuguauuuuaugcauguaggcuacuauccuucuaaucacaucgaggugguuuccgccuacgguuuaugcgacgcggcuaaccccacuaauuguauagccccagugaacggcuacuucauuaaaacaaauaacacccggaucgucgacgaauggagcuauacagggucaaguuuuuacgcacccgagccuaucacuucucucaauaccaaguauguggccccacagguaacguaccaaaacauuuccacaaaccugcccccuccgcuucugggaaauagcaccggcaucgauuuccaggacgagcuagaugaauuuuucaagaacgugucaacuagcauuccaaauuuugggagccucacccagauaaacacaacucuguuggaccugaccuaugagauguuaucccuccaacaggucguuaaagcucugaaugaaucuuacaucgaucuuaaggagcugggaaacuauacauacuacaauaaauggcccugguauauuugguugggcuucaucgcaggucucguggcccuggcgcuaugcguguuuuucauucuguguugcacgggguguggaaccaacugcaugggcaaguuaaaaugcaaucguuguugcgacagauacgaagaguaugaucucgagccucauaagguccacgugcacuga

SEQ ID NO: 634 - RNA, 4062 nt, Artificial Sequence
  derived and/or modified CDS sequence (opt3) from MERS-CoV__AKI29284__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaauuugcgaaugauacaaaaaucgcaucgcagcucgguaacugugucgaguacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaagacacaugcaacgcuguuuggcuccguggccugugaacacaucucuagcaccaugucccaguacucacggagcacucgaaguaugcucaaacgcagagacucuacauauggaccccugcagaccccugucggcugcguucuugggcugguaaauuccagcuuguucguggaggauuguaagcucccacugggacaaucguuaugcgcucugcccgacacaccuucaacucuaaccccaaggucugugcggaguguccccggugaaaugcgccucgccuccaucgcauuuaaccacccgauucagguggaucagcugaauagcucuuacuucaaacuuagcauaccuacgaacuuuuccuucggcguuacccaagaguauauccagacaacuauucagaaggugaccgucgacuguaaacaguacgugugcaauggguuccaaaagugcgaacaguugcugagagaguauggacaguuuuguucaaagaucaaccaggcgcuccauggcgcuaaucugaggcaagaugacaguguucguaacuuauucgccagcgugaaaucuucccagucaaguccaauuauccccgguuuugggggcgacuucaaucugacacuuuuggagccuguaagcauauccacuggaucucggucggcacgaagcgccaucgaagaucuccuguuugacaaggucaccauugcugaucccggcuacaugcagggguacgacgauugcaugcagcaaggaccagccucagcaagagaccuaaucugugcucaguauguggccggcuacaaagugcugccuccccucauggaugucaacauggaggcggccuauacguccagucugcuugguucuauugcugggguuggauggacagcaggcuugagcuccuucgccgcuaucccauuugcccagucaauauucuacaggcugaauggugugggcauuacccaacagguauuaucugaaaaccagaagcucaucgcaaauaaauuuaaccaggcgcugggggccaugcaaacuggauucacaaccacuaaugaggcuuuucgcaaggugcaggacgccgucaacaacaaugcacaggcucuuagcaagcuggccagugaauuguccaacaccuucggcgcaauuagcgccucuaucggggauauaauccagcggcucgacgugcuggagcaagaugcucagauugacagacuaaucaauggaaggcugacaacgcucaacgcguucguugcccagcagcuggugcgcucagaguccgcagcucuuagugcccaauuggccaaagauaaggucaaugaaugcgugaaagcucagagcaagcgaucgggcuuuuguggucaggggacccacauuguuucuuucguggucaacgcaccgaauggacuguauuuuaugcauguaggcuacuauccuuccaaccacaucgaggugguuagcgccuacgguuuaugcgacgcggcuaaucccacuaacuguauagccccagugaauggcuacuucauuaaaacaaacaauacccggaucgucgacgaauggucauauacagggaguucuuuuuacgcacccgagccuaucacuucccucaacaccaaguauguggccccacagguaacguaccaaaauauuagcacaaaccugcccccuccgcuucugggaaacucaaccggcaucgauuuccaggacgagcuagaugaauuuuucaagaaugugaguacuagcauuccaaacuuugggucccucacccagauaaauacaacucuguuggaccugaccuaugagauguuaucucuccaacaggucguuaaagcucugaacgaaagcuacaucgaucuuaaggagcugggaaauuauacauacuacaacaaauggcccugguauauuugguugggcuucaucgcaggucucguggcccuggcgcuaugcgcuuucuucauucuguguugcacgggguguggaaccaauugcaugggcaaacuuaagugcaaccguuguugcgacagauacgaagaguaugaucucgagccucauaaggugcacguccacuga

SEQ ID NO: 635 - RNA, 4062 nt, Artificial Sequence
  derived and/or modified CDS sequence (opt3) from MERS-CoV__AKL59401__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcacccgcgcuacgauccgaaaaauuuacccugcauucaugcugggcaguuccguaggcaacuuuucugaugggaagaugggacguuucuuuaaucauacucuaguucuccugccagacgguuguggcacccuucugagagccuucuacugcaucuuggagcccaggagcgggaaccacuguccugcuggaaauuccuauacaucauuugccacuuaccauaccccagcgacagauugcagugacggcaacuauaaucggaacgcaagccucaauucuuucaaggaauacuucaaccugcgcaauuguaccuuuauguauacguacaacauaacugaggaugaaauucuggagugguucgguaucacacagaccgcccaaggggugcaccucuuuuccucaagauaugucgacuuauacggaggcaauauguuccaguuugcuacucugccgguguacgacacaauuaaauauuacagcaucaucccccacaguauuaggucuauacaguccgaucggaaggccugggcagcuuucuauguguacaaacuucagccuuugaccuuucugcuagacuucagcgucgauggcuauauccgccgagccauugacugcggguuuaacgaucucucgcaacugcauuguucuuacgaguccuucgacguugaaucaggaguguauaguguaagcuccuuugaggcgaagccaucugguagcguggucgaacaggccgagggcguggagugcgauuucucaccccuucugagugggacgccuccacagguuuacaacuuuaaaagauugguguucaccaauuguaacuacaaucucacaaagcuguuaucccuguucagcgucaacgacuuuacuugcucucaaaucucacccgcagcuauagccaguaauuguuauagcucccucauucuugauuacuucucuuauccgcugucgaugaagagugacuuguccgugucaagugcuggaccuaucucucaguuuaacuacaaacagagcuucuccaauccaaccugccuaauccuggccacaguaccccacaaccucacuaccauuacaaagccucugaaauauucauacaucaauaagugcagcaggcuucugucugaugaccggaccgaaguuccccaguuggugaacgcaaaucaauauuccccaugugucaguauucuccccagcacugugugggaggacggcgauuacuaccguaaacagcugucuccuuuagaaggugggggcuggcuggucgccuccggaucaacgguggcuaugacagagcagcuacagaugggcuuugggauaaccguucaauauggaacugacaccaacagugugugcccaaagcucgaguucgcgaaugauacaaaaaucgcaagccagcuggguaacuguguagaauacucgcuuuauggcgucuccgggcgcggaguguuucagaauugcaccgccguuggcgugagacagcaaagguucgucuacgacgcuuaucagaacuugguggguuacuauucugaugacgggaacuacuacugucugcgggccugcguaagcgugccgguuucagucauuuaugauaaggagacuaagacacaugcaacgcucuuuggcaguguggccugugaacacaucuccucuaccaugagccaguacucccgaucaacucgcagcaugcugaaaagaagggacaguacauauggaccccuucagaccccugugggcugcguccugggguugguuaauucuucccucuucguggaggauuguaagcugccauuaggacaaagccugugcgcucuacccgacacaccuucgacucucaccccacggucagugcgcucuguacccggugaaaugagacuggccaguaucgcauuuaaccacccgauucaggucgaucagcuuaauuccagcuacuucaaauugucuauaccuacgaacuuuagcuucggcgugacccaagaguauauccagacaacuauucagaagguuaccguggacuguaaacaguacgucugcaauggguuccaaaagugcgaacagcugcucagggaguauggacaguuuuguuccaagaucaaccaggcgcugcauggcgcuaauuuacgucaagaugacucagugcggaaccuguucgccaguguuaaaagcucucaguccucaccaauuauccccgguuuugggggcgacuucaaucuuacauugcucgagccugugaguauaagcacuggaucccgaucugcaagaucggccaucgaagaucugcuauuugacaagguaaccauugcugaucccggcuacaugcagggguacgacgauugcaugcagcaaggaccagccagcgcaagggaccugaucugugcucaguaugucgccggcuacaaagugcucccuccccugauggaugugaacauggaggcggccuauacgucaucccuuuuggguaguauugcuggggucggauggacagcaggccugucuagcuucgccgcuaucccauuugcccaguccauauucuaccgcuuaaaugguguuggcauuacccaacaggugcucucagaaaaccagaagcugaucgcaaauaaauuuaaccaggcgcuuggggccaugcaaacuggauucacaaccacuaaugaggcuuuucggaagguacaggacgccgugaacaacaaugcacaggcucugucuaaguuggccagcgaacucaguaacaccuucggcgcaauuuccgccagcaucggggauauaauccagagacuggacguccuagagcaagaugcucagauugacaggcugaucaauggacgccucacaacgcugaacgcguucguggcccagcagcuuguucgaucugagucagcagcuuuguccgcccaacuggccaaagauaaggugaaugaaugcgucaaagcucagaguaagcggagcggcuuuuguggucaggggacccacauugugucguucguugugaacgcaccgaauggauuauauuuuaugcaugucggcuacuauccuucuaaccacaucgagguaguguccgccuacggucucugcgacgcggcuaaucccacuaacuguauagccccaguuaauggcuacuucauuaaaacaaacaauacccguaucguggacgaauggagcuauacagggucaaguuuuuacgcacccgagccuaucacuucucugaacaccaaguaugucgccccacaggugacguaccaaaauauuuccacaaaccuucccccuccgcugcuaggaaacagcaccggcaucgauuuccaggacgagcucgaugaauuuuucaagaauguaucaacuagcauuccaaacuuugggagccugacccagauaaauacaacuuugcuggacuuaaccuaugagaugcucucccugcaacagguggucaaagcucuuaacgaaucuuacaucgaucugaaggaguugggaaauuauacauacuacaacaaauggcccugguauauuuggcucggcuucaucgcaggucugguugcccuagcgcugugcguguuuuucauucuuuguugcacgggguguggaaccaauugcaugggcaagcucaaaugcaacagauguugcgacagguacgaagaguaugaucuggagccucauaaggugcacguccacuga

SEQ ID NO: 636 - RNA, 4062 nt, Artificial Sequence
  derived and/or modified CDS sequence (opt3) from MERS-CoV__AKM76229__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaguucgcgaaugauacaaaaaucgcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaagacacaugcaacgcuguuuggcuccguggccugugaacacaucucuagcaccaugucccaguacucacggagcacucgaaguaugcucaaacgcagagacucuacauauggaccccugcagaccccugucggcugcguucuugggcugguaaauuccagcuuguucguggaggauuguaagcucccacugggacaaucguuaugcgcucugcccgacacaccuucaccacuaacucccaggucugugcggagugucccgggugaaaugcgccucgccuccaucgcauuuaaccacccuauucagguggaucagcugaauagcucuuacuucaaacuuagcauaccaaccaacuuuuccuucggcguuacgcaagaguauauccagaccacaauucagaaggugacugucgacuguaaacaguacaucugcaauggguuccaaaagugcgaacaguugcugagagaguauggacaguuuuguucaaagauuaaccaggcgcuccauggcgcuaaucugaggcaagaugacagugugcguaacuuauucgccagcguuaaaucuucccagucaagucccaucauaccugguuuugggggcgacuucaaucugacccuuuuggagcccgugagcaucuccacaggaucucggucggcacgaagcgccauugaagaucuccuguuugacaagguaacuaucgcugauccaggcuacaugcagggguacgacgauugcaugcagcaaggaccugccucagcaagagaccuaauuugugcucaguaugucgccggcuacaaagugcugcccccacucauggaugugaacauggaggcggccuauaccuccagucugcuugguucuaucgcuggggucggauggacggcaggcuugagcuccuucgccgcuauaccguuugcccagucaauuuucuacaggcugaaugguguuggcaucacacaacagguguuaucugaaaaccagaagcucauugcaaauaaauuuaaccaggcgcugggggccaugcaaaccggauucacuacaaccaaugaggcuuuucgcaagguacaggacgccgugaacaacaaugcacaggcucuuagcaagcuggccagugaauuguccaacacuuucggcgcaaucagcgccucuauaggggauaucauucagcggcucgacguccuggagcaagaugcucagaucgacagacuaauuaauggaaggcugaccacacucaacgcguucguggcccagcagcugguucgcucagaguccgcagcucuuagugcccaauuggccaaagauaaggugaaugaaugcgucaaagcucagagcaagcgaucgggcuuuuguggucaggggacgcacaucgugucuuucguugugaacgcaccuaauggacuguauuuuaugcaugucggcuacuaucccuccaaccacauagagguagugagcgccuacgguuuaugcgacgcggcuaauccaaccaacuguauugcccccguuaauggcuacuucaucaaaacuaacaauacacggaucguggacgaauggucauauaccgggaguucuuuuuacuccccugagccaauuacaagccucaacacuaaguaugucgcaccccaggugaccuaccaaaauaucucaacgaaccugccuccgccacuucugggaaacaguacaggcauugauuuccaggacgagcuagaugaauuuuucaagaauguaagcaccuccauacccaacuuugggucucucacucagaucaauaccacacuguuggaccugacuuaugagauguuaagccuccaacagguggucaaagcccugaacgaauccuacauugaucuuaaggagcugggaaauuauaccuacuacaacaaauggccuugguauaucugguugggcuucauugcuggucucguugcacuggcccuaugcguguuuuucauccuguguugcacaggguguggaacgaauugcaugggcaaacuuaagugcaaccguuguugcgacagauacgaagaguaugaucucgagccacauaaggugcacguccacuga

SEQ ID NO: 637 - RNA, 4062 nt, Artificial Sequence
  derived and/or modified CDS sequence (opt3) from MERS-CoV__AKM76239__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaauugccccagcucguuaacgcaaaucaauauaguccaugugugagcauuguccccucuacugugugggaggacggcgauuacuaccggaaacagcuguccccuuuagaaggugggggcuggcuggucgccucaggaaguacgguggcuaugacagagcagcuacagaugggcuuugggauaaccguucaauauggaacugacaccaacagcgugugcccaaagcucgaguucgcgaaugauacaaaaaucgcaucgcagcuggguaacuguguagaauacucccuuuauggcgucucugggcguggaguguuucagaauugcaccgccguuggcgugcgccagcaaagauucgucuacgacgcuuaucagaacuugguggguuacuauagcgaugacgggaacuacuacugucugagggccugcguaucagugccgguuagugucauuuaugauaaggagacuaagacacaugcaacgcucuuuggcuccguggccugugaacacaucucuagcaccaugucccaguacucacggagcacucgaaguaugcugaaacgcagagacucuacauauggaccccuucagaccccugugggcugcguccugggguugguuaauuccagccucuucguggaggauuguaagcugccauuaggacaaucgcugugcgcucuacccgacacaccuucaacucucaccccaaggucugugcggaguguacccggugaaaugcgccuggccuccaucgcauuuaaccacccgauucaggucgaucagcuuaauagcucuuacuucaaauugagcauaccuacgaacuuuuccuucggcgugacccaagaguauauccagacaacuauucagaagguuaccguggacuguaaacaguacaucugcaauggguuccaaaagugcgaacagcugcucagagaguauggacaguuuuguucaaagauuaaccaggcgcugcauggcgcuaauuuaaggcaagaugacaguguccguaaccuguucgccagcgugaaaucuucccagucaaguccaaucauacccgguuuugggggcgacuucaaucuuacauugcucgagccuguuagcaucuccacuggaucucggucggcacgaagcgccauugaagaucugcuauuugacaaggugaccaucgcugaucccggcuacaugcagggguacgacgauugcaugcagcaaggaccagccucagcaagagaccugauuugugcucaguauguagccggcuacaaaguccucccuccccugauggaugugaacauggaggcggccuauacguccagucuuuuggguucuaucgcuggggugggauggacagcaggccugagcuccuucgccgcuauaccauuugcccagucaauuuucuacagguuaaauggugucggcaucacccaacagguucucucugaaaaccagaagcugauugcaaauaaauuuaaccaggcgcuuggggccaugcaaacuggauucacaaccacuaaugaggcuuuucgcaaggugcaggacgccguaaacaacaaugcacaggcucugagcaaguuggccagugaacucuccaacaccuucggcgcaaucagcgccucuauaggggauaucauucagcggcuggacgugcuagagcaagaugcucagaucgacagacugauuaauggaaggcucacaacgcugaacgcguucgucgcccagcagcuugugcgcucagaguccgcagcuuugagugcccaacuggccaaagauaagguuaaugaaugcgugaaagcucagagcaagcgaucgggcuuuuguggucaggggacccacaucgucucuuucgugguuaacgcaccgaauggauuauauuuuaugcaugugggcuacuauccuuccaaccacauagaggucguaagcgccuacggucucugcgacguggcgaaucccacuaacuguauugcuccaguuaauggcuacuucaucaaaacaaacaauacccggaucguggacgaauggucauauacagggaguucuuuuuacucccccgagccuauuacuagccugaacaccaaguaugucgccccacaggugacguaccaaaauaucucaacaaaccuucccccuccgcugcuaggaaacaguaccggcauugauuuccaggacgagcucgaugaauuuuucaagaauuuuagcacuuccauaccaaacuucgggucucugacccagaucaauacaacuuugcuggacuuaaccuaugagaugcucagccugcaacagguagugaaagcacuuaacgaauccuacauugaucugaaggaguugggaaauuauacauacuacaacaaauggcccugguauaucuggcucggcuuuauugccggucuggucgcucuagcacugugcguuuucuuuauccuuuguugcacgggguguggaaccaauugcaugggcaagcucaaaugcaaccguuguugcgacagauacgaagaguaugaucuggagccucauaaggugcacgugcacuga

SEQ ID NO: 638 - RNA, 4062 nt, Artificial Sequence
  derived and/or modified CDS sequence (opt3) from MERS-CoV__AKN11072__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcacugugcccucuacggucugggaggacggcgauuacuaccggaaacagcucuccccucuggaaggugggggcugguuaguggccucaggaaguacaguugcuaugaccgagcagcugcagaugggcuuugggauuacugugcaauauggaaccgacacaaacagcguaugcccaaagcuagaguucgcgaaugauaccaaaauagcaucgcagcucgguaacugugucgaauacucccuguauggcgugucugggcguggaguuuuucagaauugcacugccgugggcguccgccagcaaagauucguguacgacgcuuaucagaaccuuguagguuacuauagcgaugacgggaacuacuacuguuugagggccugcgugucaguuccggucagugugaucuaugauaaggagacaaagacgcaugcaacccuguuuggcuccguggccugugaacacauuucuagcacuaugucccaguacucacggagcacacgaaguaugcucaaacgcagagacucuaccuauggaccccugcagacaccugucggcugcguucuugggcugguaaauuccagcuuguucguggaggauuguaagcucccacugggacaaucguuaugcgcucugcccgacacuccuucaacccuaacgccaaggucugugcggaguguccccggugaaaugcgccucgccuccaucgcauuuaaccacccgauccagguggaucagcugaauagcucuuacuucaaacuuagcauuccuaccaacuuuuccuucggcguuacacaagaguauauacagacuaccauccagaaggugacagucgacuguaaacaguacgugugcaauggguuccaaaagugcgaacaguugcugagagaguauggacaguuuuguucaaagauuaaccaggcgcuccauggcgcuaaucugaggcaagaugacaguguucguaacuuauucgccagcgugaaaucuucccagucaaguccaaucauucccgguuuugggggcgacuucaaucugacucuuuuggagccuguaagcaucuccaccggaucucggucggcacgaagcgccauagaagaucuccuguuugacaaggucacgaucgcugaucccggcuacaugcagggguacgacgauugcaugcagcaaggaccagccucagcaagagaccuaauuugugcucaguauguggccggcuacaaagugcugccuccccucauggaugucaacauggaggcggccuauacauccagucugcuugguucuaucgcugggguuggauggaccgcaggcuugagcuccuucgccgcuauuccauuugcccagucaaucuucuacaggcugaauggugugggcauaacucaacagguauuaucugaaaaccagaagcucauugcaaauaaauuuaaccaggcgcugggggccaugcaaacaggauucaccacuaccaaugaggcuuuucgcaaggugcaggacgccgucaacaacaaugcacaggcucuuagcaagcuggccagugaauuguccaacacauucggcgcaaucagcgccucuauuggggauaucauacagcggcucgacgugcuggagcaagaugcucagaucgacagacuaauuaauggaaggcugacgacccucaacgcguucguugcccagcagcuggugcgcucagaguccgcagcucuuagugcccaauuggccaaagauaaggucaaugaaugcgugaaagcucagagcaagcgaucgggcuuuuguggucaggggacucacaucguuucuuucguggucaacgcaccgaauggacuguauuuuaugcauguaggcuacuauccuuccaaccacauugaggugguuagcgccuacgguuuaugcgacgcggcuaaucccacaaacuguaucgccccagugaauggcuacuucauaaaaaccaacaauacacggauugucgacgaauggucauauacugggaguucuuuuuacgcacccgagccuaucaccucccucaacacgaaguauguggccccacagguaacauaccaaaauaucagcaccaaccugcccccuccgcuucugggaaacucaacuggcauugauuuccaggacgagcuagaugaauuuuucaagaaugugaguaccagcaucccaaacuuugggucccucacacagauuaauacuacccuguuggaccugacauaugagauguuaucucuccaacaggucguuaaagcucugaacgaaagcuacauagaucuuaaggagcugggaaauuauacguacuacaacaaauggcccugguauaucugguugggcuucauugcaggucucguggcccuggcgcuaugcguguuuuucauccuguguugcaccggguguggaacuaauugcaugggcaaacuuaagugcaaccguuguugcgacagauacgaagaguaugaucucgagccucauaagguccacgugcacuga

SEQ ID NO: 639 - RNA, 4062 nt, Artificial Sequence
  derived and/or modified CDS sequence (opt3) from MERS-CoV__AKN11074__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcacugugcccucuacggucugggaggacggcgauuacuaccggaaacagcucuccccucuggaaggugggggcugguuaguggccucaggaaguacaguugcuaugaccgagcagcugcagaugggcuuugggauuacugugcaauauggaaccgacacaaacagcguaugcccaaagcuagaguucgcgaaugauaccaaaauagcaucgcagcucgguaacugugucgaauacucccuguauggcgugucugggcguggaguuuuucagaauugcacugccgugggcguccgccagcaacauuucguguacgacgcuuaucagaaccuuguagguuacuauagcgaugacgggaacuacuacuguuugagagccugcgugucaguuccggucagugugaucuaugauaaggagacaaagacgcacgcaacccuguuuggcuccguggccugugaacacauuucuagcacuaugucccaguacucaaggagcacacggaguaugcucaaacgacgcgacucuaccuauggaccccugcagacaccugucggcugcguucuugggcugguaaauuccagcuuguucguggaggauuguaagcucccacugggacaaucguuaugcgcucugcccgacacuccuucaacccuaacgccaagaucugugaggaguguccccggugaaaugcggcucgccuccaucgcauuuaaccauccgauccagguggaucagcugaauagcucuuacuucaaacuuagcauuccuaccaacuuuuccuucggcguuacacaagaguauauacagacuaccauccagaaggugacagucgacuguaaacaguacgugugcaauggguuccaaaagugcgaacaguugcugcgcgaguauggacaguuuuguucaaagauuaaccaggcgcuccacggcgcuaaucugagacaagaugacaguguuaggaacuuauucgccagcgugaaaucuucccagucaaguccaaucauucccgguuuugggggcgacuucaaucugacucuuuuggagccuguaagcaucuccaccggaucucguucggcacggagcgccauagaagaucuccuguuugacaaggucacgaucgcugaucccggcuacaugcagggguacgacgauugcaugcagcaaggaccagccucagcacgagaccuaauuugugcucaguauguggccggcuacaaagugcugccuccccucauggaugucaacauggaggcggccuauacauccagucugcuugguucuaucgcugggguuggauggaccgcaggcuugagcuccuucgccgcuauuccauuugcccagucaaucuucuacagacugaauggugugggcauaacucaacagguauuaucugaaaaccagaagcucauugcaaauaaauuuaaccaggcgcugggggccaugcaaacaggauucaccacuaccaaugaggcuuuuaggaaggugcaggacgccgucaacaacaaugcacaggcucuuagcaagcuggccagugaauuguccaacacauucggcgcaaucagcgccucuauuggggauaucauacagcgccucgacgugcuggagcaagaugcucagaucgaccggcuaauuaauggaagacugacgacccucaacgcguucguugcccagcagcuggugaggucagaguccgcagcucuuagugcccaauuggccaaagauaaggucaaugaaugcgugaaagcucagagcaagcgcucgggcuuuuguggucaggggacucauaucguuucuuucguggucaacgcaccgaauggacuguauuuuaugcacguaggcuacuauccuuccaaccauauugaggugguuagcgccuacgguuuaugcgacgcggcuaaucccacaaacuguaucgccccagugaauggcuacuucauaaaaaccaacaauacacgaauugucgacgaauggucauauacugggaguucuuuuuacgcacccgagccuaucaccucccucaacacgaaguauguggccccacagguaacauaccaaaauaucagcaccaaccugcccccuccgcuucugggaaacucaacuggcauugauuuccaggacgagcuagaugaauuuuucaagaaugugaguaccagcaucccaaacuuugggucccucacacagauuaauacuacccuguuggaccugacauaugagauguuaucucuccaacaggucguuaaagcucugaacgaaagcuacauagaucuuaaggagcugggaaauuauacguacuacaacaaauggcccugguauaucugguugggcuucauugcaggucucguggcccuggcgcuaugcguguuuuucauccuguguugcaccggguguggaacuaauugcaugggcaaacuuaagugcaaccgguguugcgaccguuacgaagaguaugaucucgagccucacaagguccacgugcauuga

SEQ ID NO: 640 - RNA, 4062 nt, Artificial Sequence
  derived and/or modified CDS sequence (opt3) from MERS-CoV__AKN24803__S
auggugcacagcgucuuccugcucauguuucuucugacccccacagaguccuacguugacgugggcccugauucuguaaagucagccugcaucgaaguggacauucagcaaacuuucuuugauaaaacguggccaagaccgauagacgucaguaaggcugaugggaucauuuauccccagggaaggaccuacagcaacaucacaauuacuuaucaggguuuguucccuuaccagggcgaccauggggauauguauguguacuccgcaggacacgccaccggcacaaccccacaaaaauuauuuguugcgaauuauucucaggacgugaagcaguucgcuaacgguuuugucgugcggaucggggccgcagccaauucgacuggaacaguaauaaucucacccagcaccagugcuacgauucgcaaaaucuacccugcauucaugcugggcuccucuguuggcaacuuuagcgaugggaagaugggacgauucuuuaaucauacucuagugcuccugccagacgguuguggcacccuucugcgugccuucuacugcauuuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacaucacugaggaugaaauacuggagugguucgguauuacacagaccgcccaagggguccaccucuuuucaagccgcuauguggacuuauacggaggcaauauguuccaguuugcuacucugccgguguacgacacaaucaaauauuacaguauuaucccccacucuaucagauccauucagagcgauaggaaggccugggcagcuuucuaugucuacaaacuucagccuuugaccuuucugcuagacuucucgguugauggcuauauacggcgcgccaucgacugcggguuuaacgaucucucucaacugcauuguuccuacgagucauucgacguggaaaguggaguauauagcguguccucuuuugaggcgaagccaagcgguucagucguggaacaggccgagggcguugagugcgauuucaguccccuucuguccgggacgccuccacagguguacaacuuuaaacgauuggucuucaccaauuguaacuacaauuucacaaagcuccugagcuuauuuucugugaacgacuucacuugcucacaaauuagucccgcagcuaucgccagcaauuguuauuccucucugauacucgauuacuuuucguauccgcuuagcaugaaguccgaccugucaguaaguucugcuggaccuauuagccaguucaacuacaaacaguccuuuucaaauccaaccugcuugauccuagccacaguuccccacaaccugacuaccaucacaaagccucucaaauauagcuacauuaauaagugcucuagacugcuuuccgaugacaggaccgaagugccccagcuggucaacgcaaaucaauauaguccaugugugagcaucguccccucuacugugugggaggacggcgauuacuaccggaaacaguuguccccucucgaaggugggggcuggcugguugccucaggaaguacgguggcuaugacagagcaguuacagaugggcuucgggauuaccguacaauauggaacugacaccaacagcgucucgccaaagcuggaauuugcgaaugauacaaaaauagcaucccagcuagguaacugcguggaguacucucucuauggcguuagcgggcguggaguguuccagaauuguaccgccgucggcgugcgccagcaaagauuuguauacgacgcuuaucagaaccugguggguuacuauucagaugacgggaacuacuacugccuuagggccuguguuagugucccgguguccgugaucuaugauaaggagacuaagacacaugcaacguuguucggcucugucgccugcgaacacauuagcuccaccaugucacaguacagccggaguacucgaucuaugcugaaacgcagagacuccacauauggaccccuccagaccccuguuggcugugugcuggggcuugugaauagcucgcuguuuguagaggauugcaaguugccacucggacaaucacugugugcuuuacccgacacaccuucuacucugaccccaaggaguguccgguccgugcccggugaaaugcgccuagccagcaucgcauucaaccacccgauccagguugaucagcucaauucuagcuacuuuaaacuguccauuccuacgaacuucucauucggcgugacccaagaguauauacagacaacuauccagaaggucaccguggacugcaaacaguacguuuguaauggguuucaaaagugcgaacagcuuuugagagaguauggacaguucugcaguaagauuaaccaggcgcugcauggcgcuaaucucaggcaagaugacagcgugcguaaccuguuugccucuguaaaauccucacagaguagcccaaucauucccgguuucgggggcgacuuuaauuuaacacugcuugagccugucuccaucucuacuggaucgcggagcgcacgaucagccauagaagaucuccucuucgacaaggugaccaucgcugaucccggcuacaugcagggguacgacgauuguaugcagcaaggaccagccuccgcaagagaccugauuugcgcucaguauguggccggcuacaaaguccuaccuccccugauggauguuaacauggaggcggccuauacgaguucucuccuggguagcaucgcuggggugggauggacagcaggccuuuccucauuugccgcuauuccauucgcccagucuaucuuuuacagguugaaugguguaggcauaacccaacaggugcugagcgaaaaccagaaguuaauugcaaauaaauucaaccaggcgcucggggccaugcaaacuggauuuacaaccacuaaugaggcuuuccgcaagguccaggacgccgugaacaacaaugcacaggcucugaguaaacuugccuccgaacugagcaacaccuucggcgcaaucucugccucaauuggggauaucauacagcgguuggacguucucgagcaagaugcucagaucgacagacugauuaauggaaggcuaacaacgcugaacgcguuuguggcccagcagcucguccgcuccgagagugcagcucugagcgcccaacuugccaaggauaaggugaaugaauguguuaaagcucagucgaagcgaucuggcuucugcggucaggggacccacaucguguccuuugucguaaacgcaccgaauggauuguauuucaugcaugugggcuacuauccuagcaaccacauugagguugugucagccuacggucugugugacgcggcuaaucccacuaacugcaucgccccagucaauggcuacuuuauaaaaacaaacaauacccggauuguggacgaauggaguuauacagggucuuccuucuacgcacccgagccuaucacuagcuuaaacaccaaguauguagccccacaggugacguaccaaaauaucucaacaaacuugcccccuccgcugcuuggaaacaguaccggcauugauuuucaggacgagcuggaugaguucuuuaagaaugucagcacuuccaucccaaacuucgggucucuaacccagauuaauacaacucuccuggacuugaccuaugaaaugcugagcuuacaacagguugugaaagcucucaacgaauccuacauagaucugaaggagcuuggaaauuauacauacuacaacaaauggcccugguauaucuggcugggcuuuauugcagguuugguggcccucgcgcugugugucuucuuuauccuaugcuguacggggugcggaaccaauuguaugggcaagcugaaaugcaaccguugcugugacagauacgaagaguaugaucuugagccucauaaggugcacguucacuga

SEQ ID NO: 641 - RNA, 4062 nt, Artificial Sequence
  derived and/or modified CDS sequence (opt3) from MERS-CoV__AKN24812__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucugcguguauaaacuucagccuuugaccuuucugcuagacuucucggucgauggcuacauccggcgcgccauugacuguggguuuaacgaucucucucaacugcauugcuccuaugagucauucgacguugaaaguggaguguacagcguauccucuuuugaggcgaagccaagcgguucaguggucgaacaggccgagggcguggagugugauuucaguccccuucuguccgggacgccuccacagguuuauaacuuuaaacgauugguguucaccaauugcaacuacaauuucacaaagcuccugagcuuauuuucugucaacgacuucacuuguucacaaaucagucccgcagcuauagccagcaauugcuacuccucucugauucucgauuauuuuucguacccgcuuagcaugaaguccgaccugucagugaguucugcuggaccuaucagccaguucaacuauaaacaguccuuuucaaauccaaccugcuugauccuagccacaguaccccacaaccugacuaccauuacaaagccucucaaauacagcuauaucaauaaguguucuagacugcuuuccgaugacaggaccgaaguuccccagcuggugaacgcaaaucaauacaguccaugcgucagcauugugcccucuacugucugggaggacggcgauuauuaccggaaacaguuguccccucucgaaggugggggcuggcugguggccucaggaaguacgguugcuaugacagagcaguuacagaugggcuucgggauaaccgugcaauacggaacugacaccaacagcguauguccaaagcuggaauuugcgaaugauacaaaaaucgcaucgcagcuagguaacugcgucgaguauucccucuacggcgugucugggcguggaguuuuccagaauuguaccgccgugggcguccgccagcaaagauuuguguaugacgcuuaccagaaccugguagguuauuacagcgaugacgggaacuauuacugccuuagggccugugugucaguuccggucagugugauuuacgauaaggagacuaagacacaugcaacguuguucggcuccguggccugcgaacacaucucuagcaccaugucccaguauucacggagcacucgaaguaugcugaaacgcagagacucuacauacggaccccuccagaccccugucggcuguguucuggggcuuguaaauuccagccuguuuguggaggauugcaaguugccacucggacaaucgcugugugcuuuacccgacacaccuucaacucugaccccaugcucugugaggaguguccccggugaaaugcggcuagccuccaucgcauucaaccacccgauucagguggaucagcucaauagcucuuauuuuaaacugagcauaccuacgaacuucuccuucggcguuacccaagaguacauccagacaacuauucagaaggugaccgucgacugcaaacaguauguguguaauggguuucaaaagugcgaacagcuuuugcgcgaguacggacaguucuguucaaagaucaaccaggcgcugcauggcgcuaaucucagacaagaugacaguguuaggaaccuguuugccagcgugaaaucuucccagucaaguccaauuauccccgguuucgggggcgacuuuaauuuaacacugcuugagccuguaagcauauccacuggaucucguucggcacggagcgccaucgaagaucuccucuucgacaaggucaccauugcugaucccggcuauaugcagggguacgacgauugcaugcagcaaggaccagccucagcacgagaccugaucugugcucaguacguggccggcuauaaagugcuaccuccccugauggaugucaacauggaggcggccuacacguccagucuccuggguucuauugcugggguuggauggacagcaggccuuagcuccuuugccgcuaucccauucgcccagucaauauuuuauagauugaauggugugggcauuacccaacagguacugucugaaaaccagaaguuaaucgcaaauaaauucaaccaggcgcucggggccaugcaaacuggauuuacaaccacuaaugaggcuuucaggaaggugcaggacgccgucaacaacaaugcacaggcucugagcaaacuugccagugaacuguccaacaccuucggcgcaauuagcgccucuaucggggauauaauccagcgcuuggacgugcucgagcaagaugcucagauugaccggcugaucaauggaagacuaacaacgcugaacgcguuuguugcccagcagcucgugaggucagaguccgcagcucugagugcccaacuugccaaggauaaggucaaugaaugcgugaaagcucagagcaagcgcucgggcuucuguggucaggggacccacauuguuucuuuuguggucaacgcaccgaauggauuguacuucaugcauguaggcuauuacccuuccaaccacaucgaggugguuagcgccuauggucugugcgacgcggcuaaucccacuaacuguauagccccagugaauggcuacuuuauuaaaacaaacaauacccgaaucgucgacgaauggucauacacagggaguucuuucuaugcacccgagccuaucacuuccuuaaacaccaaguacguggccccacagguaacguaucaaaauauuagcacaaacuugcccccuccgcugcuuggaaacucaaccggcaucgauuuucaggacgagcuggaugaguucuuuaagaaugugaguacuagcauuccaaacuucgggucccuaacccagauaaauacaacucuccuggacuugaccuacgaaaugcugucuuuacaacaggucguuaaagcucucaacgaaagcuauaucgaucugaaggagcuuggaaauuacacauauuacaacaaauggcccugguacauuuggcugggcuuuaucgcagguuugguggcccucgcgcugugcguguucuuuauucuauguugcacggggugcggaaccaauuguaugggcaagcugaaauccaaccggugcugugaccguuaugaagaguacgaucuugagccucauaagguccacgugcacuga

SEQ ID NO: 642 - RNA, 4062 nt, Artificial Sequence
  derived and/or modified CDS sequence (opt3) from MERS-CoV__AKN24830__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaauuucacaaagcuccugagcuuauuuucugucaacgacuucacuugcucacaaaucagucccgcagcuauagccagcaauuguuauuccucucugauucucgauuacuuuucguauccgcuuagcaugaaguccgaccugucagugaguucugcuggaccuaucagccaguucaacuacaaacaguccuuuucaaauccaaccugcuugauccuagccacaguaccccacaaccugacuaccauuacaaagccucucaaauauagcuacaucaauaagugcucuagacugcuuuccgaugacaggaccgaaguuccccagcuggugaacgcaaaucaauauaguccaugugucagcauugugcccucuacugucugggaggacggcgauuacuaccggaaacaguuguccccucucgaaggugggggcuggcugguggccucaggaccaacgguugcuaugacagagcaguuacagaugggcuucgggauaaccgugcaauauggaacugacaccaacaguguaugcccgaagcuggaauuugcgaaugauacaaaaaucgcaagccagcuagguaacugugucgaguacucgcucuauggcguguccgggcguggaguuuuccagaauugcaccgccgugggcguccgccagcaaagauuuguguacgacgcuuaucagaaccugguagguuacuauucugaugacgggaacuacuacugucuuagggccugcgugagcguucccgucucagugauuuaugauaaggagacuaagacacaugcaacguuguucggcaguguggccugugaacacaucuccucuaccaugagccaguacucccggucaacucgaagcaugcugaaacgcagagacaguacauauggaccucuccagaccccagucggcugcguucuggggcuugugaauaguucccuguuuguggaggauuguaaguugccccucggacaaagccugugcgcuuuaccugacacaccaucgacucugacccccaggucaguacggucugucccgggugaaaugcgccuagccaguaucgcauucaaccacccuauucagguggaucagcucaauuccagcuacuuuaaacugucuauaccaacgaacuucagcuucggcguuacccaagaguauauccagacaacuauucagaaggugaccgucgacuguaaacaguacgugugcaauggguuucaaaagugcgaacagcuuuugagagaguauggacaguucuguuccaagaucaaccaggcgcugcauggcgcuaaucucaggcaagaugacucaguucguaaccuguuugccagugugaaaagcucucaguccucacccauuaucccugguuucgggggcgacuuuaauuuaacacugcuugagcccguaaguauaagcacuggaucccggucugcacgaucggccaucgaagaucuucucuucgacaaggucaccauugcugauccaggcuacaugcagggguacgacgauugcaugcagcaaggaccugccagcgcaagagaccugaucugugcucaguauguggccggcuacaaagugcuacccccacugauggaugucaacauggaggcggccuauacgucaucccuccuggguaguauugcugggguuggauggacagcaggccuuucuagcuuugccgcuaucccguucgcccaguccauauuuuacagguugaauggugugggcauuacccaacagguacugucagaaaaccagaaguuaaucgcaaauaaauucaaccaggcgcucggggccaugcaaacuggauuuacaaccacuaaugaggcuuuccgcaaggugcaggacgccgucaacaacaaugcacaggcucugucuaaguuggccagcgaacugaguaacaccuucggcgcaauuuccgccagcaucggggauauaauccagcgguuggacgugcucgagcaagaugcucagauugacagacugaucaauggaaggcuaacaacgcugaacgcguuuguugcccagcagcucgugcgcucugagucagcagcucuguccgcccaacuugccaaagauaaggucaaugaaugcgugaaagcucagaguaagcgaagcggcuucuguggucaggggacccacauuguuucguuuguggucaacgcaccuaauggauuguauuucaugcauguaggcuacuaucccucuaaccacaucgaggugguuuccgccuacggucugugcgacgcggcuaauccaacuaacuguauagcccccgugaauggcuacuuuauuaaaacaaacaauacccggaucgucgacgaauggagcuauacagggucaaguuucuacgcaccugagccaaucacuucuuuaaacaccaaguauguggcuccccagguaacguaccaaaauauuuccacaaaccucccuccgccacugcuuggaaacagcaccggcaucgauuuucaggacgagcuggaugaguucuuuaagaaugugucaacuucuauucccaacuucgggagccuaacccagauaaauacaacucuccuggacuugaccuaugaaaugcuguccuuacaacaggucguuaaagcccucaacgaaucuuacaucgaucugaaggagcuuggaaauuauacauacuacaacaaauggccuugguauauuuggcugggcuuuaucgcagguuugguggcccucgcgcugugcguguucuuuauucuauguugcacgggguguggaaccaauugcaugggcaagcugaaaugcaaccguuguugcgacagauacgaagaguaugaucuugagccacauaagguccacgugcacuga

SEQ ID NO: 643 - RNA, 4062 nt, Artificial Sequence
  derived and/or modified CDS sequence (opt3) from MERS-CoV__ALB08257__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaguucgcgaaugauacaaaaaucgcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaagacacaugcaacgcuguuuggcuccguggccugugaacacaucucuagcaccaugucccaguacucacggagcacucgaaguaugcucaaacgcagagacucuacauauggaccccugcagaccccugucggcugcguucuugggcugguaaauuccagcuuguucguggaggauuguaagcucccacugggacaaucguuaugcgcucugcccgacacaccuucaacucuaaccccaaggucugugcggaguguccccggugaaaugcgccucgccuccaucgcauuuaaccacccgauucagguggaucagcugaauagcucuuacuucaaacuuagcauaccuacgaacuuuuccuucggcguuacccaagaguauauccagacaacuauucagaaggugaccgucgacuguaaacaguacgugugcaauggguuccaaaagugcgaacaguugcugagagaguauggacaguuuuguucaaagaucaaccaggcgcuccauggcgcuaaucugaggcaagaugacaguguucguaacuuauucgccagcgugaaaucuucccagucaaguccaauuauccccgguuuugggggcgacuucaaucugacacuuuuggagccuguaagcauauccacuggaucucggucggcacgaagcgccaucgaagaucuccuguuugacaaggucaccauugcugaucccggcuacaugcagggguacgacgauugcaugcagcaaggaccagccucagcaagagaccuaaucugugcucaguauguggccggcuacaaagugcugccuccccucauggaugucaacauggaggcggccuauacguccagucugcuugguucuauugcugggguuggauggacagcaggcuugagcuccuucgccgcuaucccauuugcccagucaauauucuacaggcugaauggugugggcauuacccaacagguauuaucugaaaaccagaagcucaucgcaaauaaauuuaaccaggcgcugggggccaugcaaacuggauucacaaccacuaaugaggcuuuucgcaaggugcaggacgccgucaacaacaaugcacaggcucuuagcaagcuggccagugaauuguccaacaccuucggcgcaauuagcgccucuaucggggauauaauccggagacucgacgugcuggagcaggaugcucaaauugacaggcuaaucaauggacgccugacaacgcucaacgcguucguugcccagcagcuggugcgaucagaguccgcagcucuuagugcccaguuggccaaagauaaggucaaugaaugcgugaaagcucaaagcaagcggucgggcuuuuguggucaggggacccacauuguuucuuucguggucaacgcaccgaauggacuguauuuuaugcauguaggcuacuauccuuccaaccacaucgaggugguuagcgccuacgguuuaugcgacgcggcuaaucccacuaacuguauagccccagugaauggcuacuucauuaaaacaaacaauacccguaucgucgacgaauggucauauacagggaguucuuuuuacgcacccgagccuaucacuucccucaacaccaaguauguggccccacagguaacguaccagaauauuagcacaaaccugcccccuccgcuucugggaaacucaaccggcaucgauuuccaagacgagcuagaugaauuuuucaagaaugugaguacuagcauuccaaacuuugggucccucacccagauaaauacaacucuguuggaccugaccuaugagauguuaucucuccagcaagucguuaaagcucugaacgaaagcuacaucgaucuuaaggagcugggaaauuauacauacuacaacaaauggcccugguauauuugguugggcuucaucgcaggucucguggcccuggcgcuaugcguguuuuucauucuguguugcacgggguguggaaccaauugcaugggcaaacuuaagugcaacagauguugcgacagguacgaagaguaugaucucgagccucauaagguccacgugcacuga

SEQ ID NO: 644 - RNA, 4062 nt, Artificial Sequence
  derived and/or modified CDS sequence (opt3) from MERS-CoV__ALB08311__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggauaugccaccggcacaaccccacaaaaauuauuuguggcgaauuacucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucacacucuaguucuccugccagacgguuguggcacccuucugcgugccuucuauugcaucuuggagcccagauccgggaaccauuguccugcuggaaauucauacacaaguuuugccacuuaucacaccccagcgacagauugcagcgacggcaacuacaauaggaacgcaucucucaauuccuucaaggaauauuucaaccugcggaauuguaccuuuauguacacguauaacauaacugaggaugaaauucuggagugguucgguaucacacagaccgcccaaggggugcaucucuuuucaagccgcuacgucgacuuauacggaggcaauauguuccaguuugcuacucugccgguguaugacacaauuaaauacuauaguaucaucccccacucuauuagauccauacagagcgauaggaaggccugggcagcuuucuacguguauaaacuucagccuuugaccuuucugcuagacuucucggucgauggcuacauccggcgcgccauugacugcggguuuaacgaucucucucaacugcacuguuccuaugagucauucgacguugaaaguggaguguacagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuauaaucucacaaagcuguuaagccuguucucugucaacgacuuuacuugcucacaaaucagucccgcagcuauagccagcaauuguuacuccucucucauucuugauuauuucucguacccgcugagcaugaaguccgacuugucagugaguucugcuggaccuaucagccaguuuaacuauaaacaguccuucucaaauccaaccugccuaauccuggccacaguaccccauaaccucacuaccauuacaaagccucugaaauacagcuauaucaauaagugcucuagacuucuguccgauggcaggaccgaaguuccccaguuggugaacgcaaaucaauacaguccaugugucagcauugugcccucuacugucugggaggacggugacuacuaucggaaacagcucuccccucuggaagggggcggaugguuaguggccucaggcaguacgguugcuaugacagagcagcugcagaugggguuuggaauaaccgugcaauacgguacugauaccaacagcguaugcccaaagcuagaguucgcgaaugacacaaaaaucgcaucgcagcucggcaacugugucgaauauucccuguacggggugucuggacguggcguuuuucagaauugcaccgccguggguguccgccagcaaagauucguguaugaugcuuaccagaaccuuguaggguauuacagcgacgauggcaacuacuauuguuugagggccugcgugucaguuccggucagugugauuuacgacaaggagacuaagacacacgcaacgcuguuuggauccguggccugugaacauaucucuagcaccaugucccaguauucacggagcacucgaaguaugcucaaacgcagagauucuacauacggcccccugcagaccccugucgggugcguucuuggacugguaaauuccagcuuguucguggaggacuguaagcucccacugggucaaucguuaugcgcucugcccgauacaccuucaacucuaaccccaaggucugugcggaguguccccggcgaaaugcgccucgccuccaucgcauuuaaccacccgauucagguggaccagcugaauagcucuuauuucaaacuuagcauaccuacgaacuuuuccuucgggguuacccaagaguacauccagacaacuauucagaaggugaccgucgauuguaaacaguaugugugcaauggauuccaaaagugcgaacaguugcugagagaguacggccaguuuuguucaaagaucaaccaggcgcuccacggugcuaaucugaggcaagacgauaguguucguaacuuauucgccagcgugaaaucuucccagucaaguccaauuauccccggguuuggcggagacuucaaucugacacuuuuggagccuguaagcauauccacuggcucucggucggcacgaagcgccaucgaagaccuccuguuugauaaggucaccauugcugaccccggguacaugcagggauaugaugacugcaugcagcaaggcccagccucagcaagagaucuaaucugugcucaguacguggccgguuauaaagugcugccuccccucauggacgucaacauggaggcggccuacacguccagucugcuugggucuauugcuggaguuggcuggacagcagguuugagcuccuucgccgcuaucccauuugcccagucaauauucuauaggcugaauggcguggggauuacccaacagguauuaucugaaaaccagaagcucaucgcaaauaaauuuaaccaggcgcugggagccaugcaaacuggcuucacaaccacuaaugaggcuuuucgcaaggugcaggaugccgucaacaacaaugcacaggcucuuagcaagcuggccagugaauuguccaacaccuucggggcaauuagcgccucuaucggagacauaauccagcggcucgaugugcuggagcaagacgcucagauugauagacuaaucaauggcaggcugacaacgcucaacgcguucguugcccagcagcuggugcgcucagaguccgcagcucuuagugcccaauuggccaaagacaaggucaaugaaugcgugaaagcucagagcaagcgaucggguuuuugugggcagggaacccauauuguuucuuucguggucaacgcaccgaauggccuguacuuuaugcacguagguuauuacccuuccaaccauaucgaggugguuagcgccuacggcuuaugcgaugcggcuaaucccacuaacuguauagccccagugaauggguauuucauuaaaacaaacaauacccggaucgucgacgaauggucauacacaggaaguucuuuuuaugcacccgagccuaucacuucccucaacaccaaguacguggccccacagguaacguaucaaaauauuagcacaaaccugcccccuccgcuucugggcaacucaaccgggaucgacuuccaggaugagcuagacgaauuuuucaagaaugugaguacuagcauuccaaacuuuggaucccucacccagauaaauacaacucuguuggaucugaccuacgagauguuaucucuccaacaggucguuaaagcucugaacgaaagcuauaucgaccuuaaggagcugggcaauuacacauacuauaacaaauggcccugguacauuugguuggguuucaucgcagggcucguggcccuggcgcuaugcguguuuuucauucuguguugcacgggauguggcaccaauugcauggguaaacuuaagugcaaccguuguugcgauagauaugaagaguacgaccucgagccucacaagguccaugugcacuga

SEQ ID NO: 645 - RNA, 4062 nt, Artificial Sequence
  derived and/or modified CDS sequence (opt3) from MERS-CoV__ALB08322__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggauaugccaccggcacaaccccacaaaaauuauuuguggcgaauuacucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucacacucuaguucuccugccagacgguuguggcacccuucugcgugccuucuauugcaucuuggagcccagauccgggaaccauuguccugcuggaaauucauacacaaguuuugccacuuaucacaccccagcgacagauugcagcgacggcaacuacaauaggaacgcaucucucaauuccuucaaggaauauuucaaccugcggaauuguaccuuuauguacacguauaacauaacugaggaugaaauucuggagugguucgguaucacacagaccgcccaaggggugcaucucuuuucaagccgcuacgucgacuuauacggaggcaauauguuccaguuugcuacucugccgguguaugacacaauuaaauacuauaguaucaucccccacucuauuagauccauacagagcgauaggaaggccugggcagcuuucuacguguauaaacuucagccuuugaccuuucugcuagacuucucggucgauggcuacauccggcgcgccauugacugcggguuuaacgaucucucucaacugcacuguuccuaugagucauucgacguugaaaguggaguguacagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuauaaucucacaaagcuguuaagccuguucucugucaacgacuuuacuugcucacaaaucagucccgcagcuauagccagcaauuguuacuccucucucauucuugauuauuucucguacccgcugagcaugaaguccgacuugucagugaguucugcuggaccuaucagccaguuuaacuauaaacaguccuucucaaauccaaccugccuaauccuggccacaguaccccauaaccucacuaccauuacaaagccucugaaauacagcuauaucaauaagugcucuagacuucuguccgauggcaggaccgaaguuccccaguuggugaacgcaaaucaauacaguccaugugucagcauugugcccucuacugucugggaggacggugacuacuaucggaaacagcucuccccucuggaagggggcggaugguuaguggccucaggcaguacgguugcuaugacagagcagcugcagaugggguuuggaauaaccgugcaauacgguacugauaccaacagcguaugcccaaagcuagaguucgcgaaugacacaaaaaucgcaucgcagcucggcaacugugucgaauauucccuguacggggugucuggacguggcguuuuucagaauugcaccgccguggguguccgccagcaaagauucguguaugaugcuuaccagaaccuuguaggguauuacagcgacgauggcaacuacuauuguuugagggccugcgugucaguuccggucagugugauuuacgacaaggagacuaagacacacgcaacgcuguuuggauccguggccugugaacauaucucuagcaccaugucccaguauucacggagcacucgaaguaugcucaaacgcagagauucuacauacggcccccugcagaccccugucgggugcguucuuggacugguaaauuccagcuuguucguggaggacuguaagcucccacugggucaaucguuaugcgcucugcccgauacaccuucaacucuaaccccaaggucugugcggaguguccccggcgaaaugcgccucgccuccaucgcauuuaaccacccgauucagguggaccagcugaauagcucuuauuucaaacuuagcauaccuacgaacuuuuccuucgggguuacccaagaguacauccagacaacuauucagaaggugaccgucgauuguaaacaguaugugugcaauggauuccaaaagugcgaacaguugcugagagaguacggccaguuuuguucaaagaucaaccaggcgcuccacggugcuaaucugaggcaagacgauaguguucguaacuuauucgccagcgugaaaucuucccagucaaguccaauuauccccggguuuggcggagacuucaaucugacacuuuuggagccuguaagcauauccacuggcucucggucggcacgaagcgccaucgaagaccuccuguuugauaaggucaccauugcugaccccggguacaugcagggauaugaugacugcaugcagcaaggcccagccucagcaagagaucuaaucugugcucaguacguggccgguuauaaagugcugccuccccucauggacgucaacauggaggcggccuacacguccagucugcuugggucuauugcuggaguuggcuggacagcagguuugagcuccuucgccgcuaucccauuugcccagucaauauucuauaggcugaauggcguggggauuacccaacagguauuaucugaaaaccagaagcucaucgcaaauaaauuuaaccaggcgcugggagccaugcaaacuggcuucacaaccacuaaugaggcuuuucgcaaggugcaggaugccgucaacaacaaugcacaggcucuuagcaagcuggccagugaauuguccaacaccuucggggcaauuagcgccucuaucggagacauaauccagcggcucgaugugcuggagcaagacgcucagauugauagacuaaucaauggcaggcugacaacgcucaacgcguucguugcccagcagcuggugcgcucagaguccgcagcucuuagugcccaauuggccaaagacaaggucaaugaaugcgugaaagcucagagcaagcgaucggguuuuugugggcagggaacccauauuguuucuuucguggucaacgcaccgaauggccuguacuuuaugcacguagguuauuacccuuccaaccauaucgaggugguuagcgccuacggcuuaugcgaugcggcuaaucccacuaacuguauagccccagugaauggguauuucauuaaaacaaacaauacccggaucgucgacgaauggucauacacaggaaguucuuuuuaugcacccgagccuaucacuucccucaacaccaaguacguggccccacagguaacguaucaaaauauuagcacaaaccugcccccuccgcuucugggcaacucaaccgggaucgacuuccaggaugagcuagacgaauuuuucaagaaugugaguacuagcauuccaaacuuuggaucccucacccagauaaauacaacucuguuggaucugaccuacgagauguuaucucuccaacaggucguuaaagcucugaacgaaagcuauaucgaccuuaaggagcugggcaauuacacauacuauaacaaauggcccugguacauuugguuggguuucaucgcagggcucguggcccuggcgcuaugcguguuuuucauucuguguugcacgggauguggcaccaauugcauggguaaacuuaagugcaaccguuguugcgauagauaugaagaguacgaccucgagcugcacaagguccaugugcacuga

SEQ ID NO: 646 - RNA, 4062 nt, Artificial Sequence
  derived and/or modified CDS sequence (opt3) from MERS-CoV__ALD51904__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaguucgcgaaugauacaaaaaucgcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaagacacaugcaacgcuguuuggcuccguggccugugaacacaucucuagcaccaugucccaguacucacggagcacucgaaguaugcucaaacgcagagacucuacauauggaccccugcagaccccugucggcugcguucuugggcuggugaauaguagcuuguucguggaggauuguaagcucccacugggacaaucguuaugcgcucugcccgacacaccuucaacucuaaccccaaggucuguacggaguguccccggugaaaugcgccucgccuccaucgcauuuaaccacccgauucagguggaucagcugaauagcucuuacuucaaacuuagcauaccuacgaacuuuuccuucggcguuacccaagaguauauccagacaacuauucagaaggugaccgucgacuguaaacaguacgugugcaauggguuccaaaagugcgaacaguugcugagagaguauggacaguuuugugcgaagaucaaccaggcucuccauggcgccaaucugaggcaagaugacucaguucguaacuuauucgcaagugugaaaagcucucaguccucaccaauuauccccgguuuugggggcgacuucaaucugacacuuuuggagccuguaaguauaagcacuggaucccggucugcccgaucggcuaucgaagaucuccuguuugacaaggucaccauugccgaucccggcuacaugcagggguacgacgauugcaugcagcaaggaccagcaagcgcuagagaccuaaucugugcccaguauguggcgggcuacaaagugcugccuccccucauggaugucaacauggaggccgcuuauacgucaucccugcuugguaguauugcagggguuggauggacagccggcuugucuagcuucgcugccaucccauuugcacaguccauauucuacaggcugaauggugugggcauuacccaacagguauuaucagaaaaccagaagcucaucgcgaauaaauuuaaccaggcccugggggcuaugcaaacuggauucacaaccacuaaugaggccuuucgcaaggugcaggacgcagucaacaacaaugcucaggcccuuucuaagcuggcaagcgaauugaguaacaccuucggcgccauuuccgcuagcaucggggauauaauccagcggcucgacgugcuggagcaagaugcgcagauugacagacuaaucaauggaaggcugacaacgcucaacgccuucguugcacagcagcuggugcgcucugagucagcugcccuuuccgcccaauuggcuaaagauaaggucaaugaaugcgugaaagcacagaguaagcgaagcggcuuuuguggucaggggacccacauuguuucguucguggucaacgccccgaauggacuguauuuuaugcauguaggcuacuauccuucuaaccacaucgaggugguuuccgcguacgguuuaugcgacgcugccaaucccacuaacuguauagcaccagugaauggcuacuucauuaaaacaaacaauacccggaucgucgacgaauggagcuauacagggucaaguuuuuacgcccccgagccuaucacuucucucaacaccaaguauguggcuccacagguaacguaccaaaauauuuccacaaaccugcccccuccgcuucugggaaacagcaccggcaucgauuuccaggacgagcuagaugaauuuuucaagaaugugucaacuuccauuccaaacuuugggagccucacccagauaaauacaacucuguuggaccugaccuaugagauguuaucccuccaacaggucguuaaagcacugaacgaaucuuacaucgaucuuaaggagcugggaaauuauacauacuacaacaaauggcccugguauauuugguugggcuucaucgccggucucguggcgcuggcucuaugcguguuuuucauucuguguugcacgggguguggaaccaauugcaugggcaaacuuaagugcaaccguuguugcgacagauacgaagaguaugaucucgagccucauaagguccacgugcacuga

SEQ ID NO: 647 - RNA, 4062 nt, Artificial Sequence
  derived and/or modified CDS sequence (opt3) from MERS-CoV__ALJ54446__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauuuuuauacaucauucgccacuuaccauaccccagcgacagauugcagugacggcaacuauaauaggaacgcaagccucaauucuuucaaggaauacuuuaaccugcggaauuguaccuucauguauacguacaacauaacugaggaugaaauucuggagugguuugguaucacacagaccgcccaaggggugcaccucuucuccucacgcuaugucgacuuauacggaggcaauauguuucaguucgcuacucugccgguguacgacacaauuaaauauuacagcaucaucccccacaguauuagaucuauacaguccgauaggaaggccugggcagcuuuuuauguguacaaacuucagccuuugaccuuccugcuagacuuuagcgucgauggcuauauccggcgcgccauugacugcggguucaacgaucucucgcaacugcauuguucuuacgaguccuuugacguugaaucaggaguguauaguguaagcuccuucgaggcgaagccaucugguagcguggucgaacaggccgagggcguggagugcgauuuuucaccccuucugagugggacgccuccacagguuuacaacuucaaacgauugguguucaccaauuguaacuacaaucucacaaagcuguuaucccuguuuagcgucaacgacuucaucugcucucaaauaucacccgcagcuauugccaguaauuguuauagcucccucauccuugauuacuuuucuuauccgcugucgaugaaaagcgacuuguccgugucaagugcuggaccuaucucucaguucaacuacaagcagagcuuuuccaaucccacuugccuaauucuggccaccguaccacacaaccucacaacuaucaccaagccucugaaauauucauacauuaauaagugcagcagacuucugucugaugacaggacagaaguuccccaguuggugaacgcaaaucaauauuccccaugugucaguauagugcccagcaccgucugggaggacggcgauuacuaccggaaacagcucucuccucuggaaggugggggcugguuaguggccuccggaucaacuguugcuaugacggagcagcugcagaugggcuucgggaucacagugcaauauggaaccgacacuaacaguguaugcccaaagcuagaauuugcgaaugauaccaaaauugcaagccagcucgguaacugugucgaguacucgcuguauggcguguccgggcguggaguuuuccagaauugcacagccgugggcguccgccagcaaagauuuguguacgacgcuuaucagaaccuuguagguuacuauucugaugacgggaacuacuacuguuugagggccugcgugagcguuccggucucagugaucuaugauaaggagaccaagacucaugcaacacuguucggcaguguggccugugaacacaucuccucuacgaugagccaguacucccggucaacccgaagcaugcucaaacgcagagacaguacuuauggaccccugcagacaccugucggcugcguucuugggcuggugaauagcuccuuguuuguggaggauuguaagcucccacugggacaaucuuuaugcgcucugcccgacaccccuucgacacuaacuccaaggucaguacggucuguccccggugaaaugcgccucgccaguauugcauucaaccacccgauacagguggaucagcuuaauuccagcuacuuuaaacuuucuaucccuaccaacuucagcuucggcguuacgcaagaguauauucagaccacaauccagaaggugacugucgacuguaaacaguacgugugcaauggguuucaaaagugcgaacaguugcugagagaguauggacaguucuguuccaagauuaaccaggcgcuccauggcgcuaaucugaggcaagaugacucaguucguaacuuauuugccagugugaaaagcucucaguccucaccaaucauacccgguuucgggggcgacuuuaaucugacccuuuuggagccuguaaguaucagcacaggaucccggucugcacgaucggccauugaagaucuccuguucgacaaggucacuaucgcugaucccggcuacaugcagggguacgacgauugcaugcagcaaggaccagccagcgcaagagaccuaauuugugcucaguauguggccggcuacaaagugcugccuccccucauggaugucaacauggaggcggccuauaccucaucccugcuugguaguaucgcugggguuggauggacggcaggcuugucuagcuuugccgcuauaccauucgcccaguccaucuuuuacaggcugaauggugugggcauuacacaacagguauuaucagaaaaccagaagcucauugcaaauaaauucaaccaggcgcugggggccaugcaaaccggauuuacuacaaccaaugaggcuuuccgcaaggugcaggacgccgucaacaacaaugcacaggcucuuucuaagcuggccagcgaauugaguaacacuuucggcgcaaucuccgccagcauaggggauaucauucagcggcucgacgugcuggagcaagaugcucagaucgacagacuaauuaauggaaggcugaccacacucaacgcguuuguugcccagcagcuggugcgcucugagucagcagcucuuuccgcccaauuggccaaagauaaggucaaugaaugcgugaaagcucagaguaagcgaagcggcuucuguggucaggggacgcacaucguuucguuuguggucaacgcaccgaauggacuguauuucaugcauguaggcuacuauccuucuaaccacauagaggugguuuccgccuacgguuuaugcgacgcggcuaaucccaccaacuguauugccccagugaauggcuacuuuaucaaaacuaacaauacacggaucgucgacgaauggagcuauaccgggucaaguuucuacgcacccgagccuauuacaucucucaacacuaaguauguggccccacagguaaccuaccaaaauaucuccacgaaccugcccccuccgcuucugggaaacagcacaggcauugauuuucaggacgagcuagaugaguucuuuaagaaugugucaaccaguauaccaaacuucgggagccucacucagaucaauaccacacuguuggaccugacuuaugaaauguuaucccuccaacaggucguuaaagcucugaacgaaucuuacauugaucuuaaggagcugggaaauuauaccuacuacaacaaauggcccugguauaucugguugggcuuuauugcaggucucguggcccuggcgcuaugcguguucuuuauccuguguugcacaggguguggaacgaauugcaugggcaagcugaaaugcaaccguuguugcgacagauacgaagaguaugaucucgagccucauaagguccacgugcacuga

SEQ ID NO: 648 - RNA, 4062 nt, Artificial Sequence
  derived and/or modified CDS sequence (opt3) from MERS-CoV__ALJ54448__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaauacucaauucuuucaaggaauacuucaaccugcggaauuguaccuuuauguauacguacaacauuacugaggaugaaauccuggagugguucgguauuacacagaccgcccaaggggugcaccucuuuuccucacgcuaugucgacuuauacggaggcaauauguuccaguuugcuacucugccgguguacgacacaaucaaauauuacagcaucauuccccacaguauaagaucuauccaguccgauaggaaggccugggcagcuuucuauguguacaaacuucagccuuugaccuuucugcuagacuucagcgucgauggcuauauucggcgcgccaucgacugcggguuuaacgaucucucgcaacugcauuguucuuacgaguccuucgacguugaaucaggaguguauaguguaagcuccuuugaggcgaagccaucugguagcguggucgaacaggccgagggcguggagugcgauuucucaccccuucugagugggacgccuccacagguuuacaacuuuaaacgauugguguucaccaauuguaacuacaaucucacaaagcuguuaucccuguucagcgucaacgacuuuacuugcucucaaauaucacccgcagcuauugccaguaauuguuauagcucccucauccuugauuacuucucuuauccgcugucgaugaaaagcgacuuguccgugucaagugcuggaccuaucucucaguuuaacuacaagcagagcuucuccaauccaaccugccuaauucuggccacaguaccccacaaccucacuaccaucacaaagccucugaaauauucauacauuaauaagugcagcagacuucugucugaugacaggaccgaaguuccccaguuggugaacgcaaaucaauauuccccaugugucaguauagugcccagcacugucugggaggacggcgauuacuaccggaaacagcucucuccucuggaaggugggggcugguuaguggccuccggaucaacgguugcuaugacagagcagcugcagaugggcuuugggaucaccgugcaauauggaacugacaccaacaguguaugcccaaagcuagaguucgcgaaugauacaaaaauugcaagccagcucgguaacugugucgaauacucgcuguauggcguguccgggcguggaguuuuucagaauugcaccgccgugggcguccgccagcaaagauucguguacgacgcuuaucagaaccuuguagguuacuauucugaugacgggaacuacuacuguuugagggccugcgugagcguuccggucucagugaucuaugauaaggagacuaagacacaugcaacgcuguuuggcaguguggccugugaacacaucuccucuaccaugagccaguacucccggucaacucgaagcaugcucaaacgcagagacaguacauauggaccccugcagaccccugucggcugcguucuugggcugguaaauucuuccuuguucguggaggauuguaagcucccacugggacaaaguuuaugcgcucugcccgacacaccuucgacucuaaccccaaggucagugcggucuguccccggugaaaugcgccucgccaguauugcauuuaaccacccgauacagguggaucagcuuaauuccagcuacuucaaacuuucuaucccuacgaacuuuagcuucggcguuacccaagaguauauucagacaacuauccagaaggugaccgucgacuguaaacaguacgugugcaauggguuccaaaagugcgaacaguugcugagagaguauggacaguuuuguuccaagauuaaccaggcgcuccauggcgcuaaucugaggcaagaugacucaguucguaacuuauucgccagugugaaaagcucucaguccucaccaaucauacccgguuuugggggcgacuucaaucugacacuuuuggagccuguaaguaucagcacuggaucccggucugcacgaucggccauugaagaucuccuguuugacaaggucaccaucgcugaucccggcuacaugcagggguacgacgauugcaugcagcaaggaccagccagcgcaagagaccuaauuugugcucaguauguggccggcuacaaagugcugccuccccucauggaugucaacauggaggcggccuauacgucaucccugcuugguaguaucgcugggguuggauggacagcaggcuugucuagcuucgccgcuauaccauuugcccaguccauuuucuacaggcugaauggugugggcaucacccaacagguauuaucagaaaaccagaagcucauugcaaauaaauuuaaccaggcgcugggggccaugcaaacuggauucacaaccacuaaugaggcuuuucgcaaggugcaggacgccgucaacaacaaugcacaggcucuuucuaagcuggccagcgaauugaguaacaccuucggcgcaaucuccgccagcauaggggauaucauucagcggcucgacgugcuggagcaagaugcucagaucgacagacuaauuaauggaaggcugacaacgcucaacgcguucguugcccagcagcuggugcgcucugagucagcagcucuuuccgcccaauuggccaaagauaaggucaaugaaugcgugaaagcucagaguaagcgaagcggcuuuuguggucaggggacccacaucguuucguucguggucaacgcaccgaauggacuguauuuuaugcauguaggcuacuauccuucuaaccacauagaggugguuuccgccuacgguuuaugcgacgcggcuaaucccacuaacuguauugccccagugaauggcuacuucaucaaaacaaacaauacccggaucgucgacgaauggagcuauacagggucaaguuuuuacgcacccgagccuauuacuucucucaacaccaaguauguggccccacagguaacguaccaaaauaucuccacaaaccugcccccuccgcuucugggaaacagcaccggcauugauuuccaggacgagcuagaugaauuuuucaagaaugugucaacuagcauaccaaacuuugggagccucacccagaucaauacaacucuguuggaccugaccuaugagauguuaucccuccaacaggucguuaaagcucugaacgaaucuuacauugaucuuaaggagcugggaaauuauacauacuacaacaaauggcccugguauaucugguugggcuucauugcaggucucguggcccuggcgcuaugcguguuuuucauccuguguugcacgggguguggaaccaauugcaugggcaagcugaaaugcaaccguuguugcgacagauacgaagaguaugaucucgagccucauaagguccacgugcacuga

SEQ ID NO: 649 - RNA, 4062 nt, Artificial Sequence
  derived and/or modified CDS sequence (opt3) from MERS-CoV__ALJ54450__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauagguacgcaucucucaacuccuucaaggaauauuucaaucugcggaacuguaccuuuauguacacguauaauauaacugaggaugaaauucuggagugguucgguaucacacagaccgcccaaggggugcaccucuuuucaagccgcuacgucgacuuauacggaggcaacauguuccaguuugcuacucugccgguguaugacacaauuaaauacuauaguaucaucccccacucuauuagauccauacagagcgauaggaaggccugggcagcuuucuacguguauaaacuucagccuuugaccuuucugcuagacuucucggucgauggcuacauccggcgcgccauugacugcggguuuaaugaucucucucaacugcauuguuccuaugagucauucgacguugaaaguggaguguacagcguauccucuuuugaggcgaagccaagcgguucaguggucgaacaggccgagggcguggagugcgauuucaguccccuucuguccgggacgccuccacagguuuacaacuuuaaacgauugguguucaccaacuguaauuauaaccucacaaagcuguuaagccuguucucugucaaugacuuuacuugcucacaaaucagucccgcagcuauagccagcaacuguuacuccucucucauucuugauuauuucucguacccgcugagcaugaaguccgacuugucagugaguucugcuggaccuaucagccaguuuaauuauaaacaguccuucucaaacccaaccugccuaauccuggccacaguaccccacaaucucacuaccauuacaaagccucugaaauacagcuauaucaacaagugcucuagacuucuguccgaugacaggaccgaaguuccccaguuggugaaugcaaaccaauacaguccaugugucagcauugugcccucuacugucugggaggacggcgauuacuaucggaaacagcucuccccucuggaaggugggggcugguuaguggccucaggaaguacgguugcuaugacagagcagcugcagaugggcuuugggauaaccgugcaauacggaacugacaccaauagcguaugcccaaagcuagaguucgcgaacgauacaaaaaucgcaucgcagcucgguaauugugucgaauauucccuguacggcgugucugggcguggaguuuuucagaacugcaccgccgugggcguccgccagcaaagauucguguaugacgcuuaccagaaucuuguagguuauuacagcgaugacgggaacuacuauuguuugagggccugcgugucaguuccggucagugugauuuacgauaaggagacuaagacacaugcaacgcuguuuggcuccguggccugugaacacaucucuagcaccaugucccaguauucacggagcacucgaaguaugcucaaacgcagagacucuacauacggaccccugcagaccccugucggcugcguucuugggcuggugaacuccagcuuguucguggaggauuguaagcucccacugggacaaucguuaugcgcucugcccgacacaccuucaacucuaaccccaaggucuguacggaguguccccggugaaaugcgccucgccuccaucgcauuuaaucacccgauucagguggaucagcugaacagcucuuauuucaaacuuagcauaccuacgaauuuuuccuucggcguuacccaagaguacauccagacaacuauucagaaggugaccgucgacuguaaacaguaugugugcaacggguuccaaaagugcgaacaguugcugagagaguacggacaguuuuguucaaagaucaaucaggcgcuccauggcgcuaaccugaggcaagaugacaguguucguaauuuauucgccagcgugaaaucuucccagucaaguccaauuauccccgguuuugggggcgacuucaaccugacacuuuuggagccuguaagcauauccacuggaucucggucggcacgaagcgccaucgaagaucuccuguuugacaaggucaccauugcugaucccggcuacaugcagggguaugacgauugcaugcagcaaggaccagccucagcaagagaccuaaucugugcucaguacguggccggcuauaaagugcugccuccccucauggaugucaauauggaggcggccuacacguccagucugcuugguucuauugcugggguuggauggacagcaggcuugagcuccuucgccgcuaucccauuugcccagucaauauucuauaggcugaacggugugggcauuacccaacagguauuaucugaaaaucagaagcucaucgcaaacaaauuuaaucaggcgcugggggccaugcaaacuggauucacaaccacuaacgaggcuuuucgcaaggugcaggacgccgucaauaacaacgcacaggcucuuagcaagcuggccagugaauuguccaauaccuucggcgcaauuagcgccucuaucggggauauaauccagcggcucgacgugcuggagcaagaugcucagauugacagacuaaucaacggaaggcugacaacgcucaaugcguucguugcccagcagcuggugcgcucagaguccgcagcucuuagugcccaauuggccaaagauaaggucaacgaaugcgugaaagcucagagcaagcgaucgggcuuuuguggucaggggacccacauuguuucuuucguggucaaugcaccgaacggacuguacuuuaugcauguaggcuauuacccuuccaaucacaucgaggugguuagcgccuacgguuuaugcgacgcggcuaaccccacuaauuguauagccccagugaacggcuauuucauuaaaacaaauaacacccggaucgucgacgaauggucauacacagggaguucuuuuuaugcacccgagccuaucacuucccucaauaccaaguacguggccccacagguaacguaucaaaacauuagcacaaaucugcccccuccgcuucugucaaacaguaccggaaucgauuuccaggacgagcuagaugaauuuuucaagaacgugagcacuuccauuccaaauuuuggcucucucacccagauaaacacaacucuguuggaccugaccuacgagauguuaagccuccaacaggucguuaaagcucugaaugaauccuauaucgaucuuaaggagcuggggaacuacacauacuauaauaaauggcccugguacauuugguugggauucaucgcaggccucguggcccuggcgcuaugcguguuuuucauucuguguugcacggguugugggaccaacugcaugggaaaacuuaagugcaaucguuguugcgacagauaugaagaguacgaucucgagccucauaagguccacgugcacuga

SEQ ID NO: 650 - RNA, 4062 nt, Artificial Sequence
  derived and/or modified CDS sequence (opt3) from MERS-CoV__ALJ54453__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaacuauuguccugcuggaaauucauacacaaguuuugccacuuaucacaccccagcgacagauugcagcgacggcaacuacaauaggaacgcaucucucaauuccuucaaggaauauuucaaccugcggaauuguaccuuuauguacacguauaacauaacugaggaugaaauucuggagugguucgguaucacacagaccgcccaaggggugcaucucuuuucaagccgcuacgucgacuuauacggaggcaauauguuccaguuugcuacucugccgguguaugacacaauuaaauacuauaguaucaucccccacucuauuagauccauacagagcgauaggaaggccugggcagcuuucuacguguauaaacuucagccuuugaccuuucugcuagacuucucggucgauggcuacauccggcgcgccauugacugcggguuuaacgaucucucucaacugcacuguuccuaugagucauucgacguugaaaguggaguguacagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuauaaucucacaaagcuguuaagccuguucucugucaacgacuuuacuugcucacaaaucagucccgcagcuauagccagcaauuguuacuccucucucauucuugauuauuucucguacccgcugagcaugaaguccgacuugucagugaguucugcuggaccuaucagccaguuuaacuauaaacaguccuucucaaauccaaccugccuaauccuggccacaguaccccauaaccucacuaccauuacaaagccucugaaauacagcuauaucaauaagugcucuagacuucuguccgaugacaggaccgaaguuccccaguuggugaacgcaaaucaauacaguccaugugucagcauugugcccucuacugucugggaggacggcgauuacuaucggaaacagcucuccccucuggaaggugggggcugguuaguggccucaggaaguacgguugcuaugacagagcagcugcagaugggcuuugggauaaccgugcaauacggaacugacaccaacagcguaugcccaaagcuagaguucgcgaaugauacaaaaaucgcaucgcagcucgguaacugugucgaauauucccuguacggcgugucugggcguggaguuuuucagaauugcaccgccgugggcguccgccagcaaagauucguguaugacgcuuaccagaaccuuguagguuauuacagcgaugacgggaacuacuauuguuugagggccugcgugucaguuccggucagugugauuuacgauaaggagacuaagacacacgcaacgcuguuuggcuccguggccugugaacauaucucuagcaccaugucccaguauucacggagcacucgaaguaugcucaaacgcagagacucuacauacggaccccugcagaccccugucggcugcguucuugggcugguaaauuccagcuuguucguggaggauuguaagcucccacugggacaaucguuaugcgcucugcccgacacaccuucaacucuaaccccaaggucugugcggaguguccccggugaaaugcgccucgccuccaucgcauuuaaccacccgauucagguggaucagcugaauagcucuuauuucaaacuuagcauaccuacgaacuuuuccuucggcguuacccaagaguacauccagacaacuauucagaaggugaccgucgacuguaaacaguaugugugcaauggguuccaaaagugcgaacaguugcugagagaguacggacaguuuuguucaaagaucaaccaggcgcuccacggcgcuaaucugaggcaagaugacaguguucguaacuuauucgccagcgugaaaucuucccagucaaguccaauuauccccgguuuugggggcgacuucaaucugacacuuuuggagccuguaagcauauccacuggaucucggucggcacgaagcgccaucgaagaucuccuguuugacaaggucaccauugcugaucccggcuacaugcagggguaugacgauugcaugcagcaaggaccagccucagcaagagaccuaaucugugcucaguacguggccggcuauaaagugcugccuccccucauggaugucaacauggaggcggccuacacguccagucugcuugguucuauugcugggguuggauggacagcaggcuugagcuccuucgccgcuaucccauuugcccagucaauauucuauaggcugaauggugugggcauuacccaacagguauuaucugaaaaccagaagcucaucgcaaauaaauuuaaccaggcgcugggggccaugcaaacuggauucacaaccacuaaugaggcuuuucgcaaggugcaggacgccgucaacaacaaugcacaggcucuuagcaagcuggccagugaauuguccaacaccuucggcgcaauuagcgccucuaucggggauauaauccagcggcucgacgugcuggagcaagaugcucagauugacagacuaaucaauggaaggcugacaacgcucaacgcguucguugcccagcagcuggugcgcucagaguccgcagcucuuagugcccaauuggccaaagauaaggucaaugaaugcgugaaagcucagagcaagcgaucgggcuuuuguggucaggggacccauauuguuucuuucguggucaacgcaccgaauggacuguacuuuaugcacguaggcuauuacccuuccaaccauaucgaggugguuagcgccuacgguuuaugcgacgcggcuaaucccacuaacuguauagccccagugaauggcuauuucauuaaaacaaacaauacccggaucgucgacgaauggucauacacagggaguucuuuuuaugcacccgagccuaucacuucccucaacaccaaguacguggccccacagguaacguaucaaaauauuagcacaaaccugcccccuccgcuucugggaaacucaaccggcaucgauuuccaggacgagcuagaugaauuuuucaagaaugugaguacuagcauuccaaacuuugggucccucacccagauaaauacaacucuguuggaccugaccuacgagauguuaucucuccaacaggucguuaaagcucugaacgaaagcuauaucgaucuuaaggagcugggaaauuacacauacuauaacaaauggcccugguacauuugguugggcuucaucgcaggucucguggcccuggcgcuaugcguguuuuucauucuguguugcacgggguguggaaccaauugcaugggcaaacuuaagugcaaccguuguugcgacagauaugaagaguacgaucucgagccucacaagguccaugugcacuga

SEQ ID NO: 651 - RNA, 4062 nt, Artificial Sequence
  derived and/or modified CDS sequence (opt3) from MERS-CoV__ALJ54455__S
augauccacagcguguuccugcucauguuucuucugacccccacagaguccuacgucgacguuggcccugauucugugaagucagccugcauugcuguagacauacagcaaacuuucuuugauaaaacguggccaagaccgaucgacgugaguaaggcagaugggauuaucuauccccagggaaggaccuacagcaacauuacaaucacuuaucaggguuuguucccuuaccagggcgaccauggggauauguaugucuacuccgccggacacgcgaccggcacaaccccacaaaaauuauuuguggcuaauuauucucaggacguuaagcaguucgccaacgguuuugugguccggauaggggcagccgcuaauucgacuggaacagugaucauuucacccagcaccagugcaacgauccgcaaaauuuacccugccuucaugcugggcuccucuguaggcaacuuuagcgaugggaagaugggacgauucuuuaaucauacucuaguucuccugccagacgguuguggcacccuucugcgugcuuucuacugcaucuuggaacccagauccgggaaccacuguccugccggaaauucauauacaaguuuugcgacuuaccauaccccagcaacagauugcagcgacggcaacuauaauaggaacgccucucucaauuccuucaaggaguacuucaaccugcggaauuguaccuuuauguauacguacaacauaacugaagaugagauucuggaaugguucgguaucacacagaccgcucaaggggugcaccucuuuucaagccgcuaugucgacuuauacggaggcaauauguuccaguuugccacucugccgguguacgacacaauuaaauauuacaguaucaucccccacucuauuagauccauacagagcgauaggaaggcaugggcugccuucuauguguacaaacuucagccuuugaccuuucugcuagacuucucggucgauggcuauauccggcgcgcgauugacugcggguuuaacgaucucucucaacugcauuguuccuacgagucauucgacguugagaguggaguguauagcguauccucuuuugaagccaagccaagcgguucaguggucgagcaggcagaaggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcugccauagcuagcaauuguuauuccucucucauucuugauuacuucucguauccgcugagcaugaaguccgacuugucagugaguucugccggaccuaucagccaguuuaacuacaaacaguccuucucaaauccaaccugccuaauccuggcaacaguaccccacaaccucacuaccauuacaaagccucugaaauauagcuacaucaauaagugcucuagacuucuguccgaugacaggaccgagguuccccaguuggugaacgccaaucaauauaguccaugugucagcauugugcccucuacugucugggaagacggcgauuacuaccggaaacagcucuccccucuggagggugggggcugguuaguggcuucaggaaguacgguugcgaugacagaacagcugcagaugggcuuugggauaaccgugcaauauggaacugacaccaacagcguaugcccaaagcuagaguucgcaaaugauacaaaaaucgccucgcagcucgguaacugugucgaauacucccuguauggcgugucugggcguggaguuuuucagaauugcaccgcugugggcguccgccagcaaagauucguguacgacgccuaucagaaccuuguagguuacuauagcgaugacgggaacuacuacuguuugagggcaugcgugucaguuccggucagugugauuuaugauaaggagacuaagacacaugccacgcuguuuggcuccguggcuugugagcacaucucuagcaccaugucccaguacucacggagcacucgaaguaaacucaagcgcagagacucuacauauggaccccugcagaccccugucggcugcguucuugggcugguaaauuccagcuuguucguggaagauuguaaacucccacugggacaaucguuaugcgcccugcccgacacaccuucaacucuaaagccaaggucugugcggaguguccccggugagaugcgccucgcauccaucgcguuuaaccacccgauucagguggaucagcugaauagcucuuacuucaaacuuagcauaccuaccaacuuuuccuucggcguuacgcaagaauauauccagaccacaauucagaaggugacugucgacuguaagcaguacgugugcaauggguuccaaaaaugcgagcaguugcugagagaauauggacaguuuuguucaaagaucaaccaggcucuccauggcgccaaucugaggcaagaugacaguguucguaacuuauucgcaagcgugaaaucuucccagucaaguccaauuauccccgguuuugggggcgacuucaaucugacccuuuuggagccuguaagcauauccacaggaucucggucggcccgaagcgcuaucgaggaucuccuguuugacaaggucacuauugccgaucccggcuacaugcagggguacgacgauugcaugcagcaaggaccagcaucagcuagagaccuaaucugugcccaguauguggcgggcuacaaagugcugccuccccucauggaugucaacauggaagccgcuuauaccuccagucugcuugguucuauugcagggguuggauggacggccggcuugagcuccuucgcugccaucccauuugcacagucaauauucuacaggcugaauggugugggcauuacacaacagguauuaucugagaaccagaagcucaucgcgaauaaguuuaaccaggcccugggggcuaugcaaaccggauucacuacaaccaaugaagccuuucgcaaagugcaggacgcagucaacaacaaugcucaggcccuuagcaagcuggcaagugaguuguccaacacuuucggcgccauuagcgcuucuaucggggauauaauccagcggcucgacgugcuggaacaagaugcgcagauugacagacuaaucaauggaaggcugaccacacucaacgccuucguugcacagcagcuggugcgcucagaguccgcugcccuuagugcccaauuggcuaaagauaaggucaaugagugcgugaaagcacagagcaagcgaucgggcuuuuguggucaggggacgcacauuguuucuuucguggucaacgccccgaauggacuguauuuuaugcauguaggcuacuauccuuccaaccacaucgaagugguuagcgcguacgguuuaugcgacgcugccaaucccaccaacuguauagcaccagugaauggcuacuucauuaagacuaacaauacacggaucgucgacgaguggucauauaccgggaguucuuuuuacgcccccgaaccuaucacaucccucaacacuaaauauguggcuccacagguaaccuaccaaaauauuagcacgaaccugcccccuccgcuucugggaaacucaacaggcaucgauuuccaggacgagcuagaugaguuuuucaagaaugugaguaccagcauuccaaacuuugggucccucacucagauaaauaccacacuguuggaccugacuuaugaaauguuaucucuccaacaggucguuaaagcacugaacgagagcuacaucgaucuuaaggaacugggaaauuauaccuacuacaacaaauggcccugguauauuugguugggcuucaucgccggucucguggcgcuggcucuaugcguguuuuucauucuguguugcacaggguguggaacgaauugcaugggcaaacuuaagugcaaccguuguugcgacagauacgaggaauaugaucucgagccucauaagguccacgugcacuga

SEQ ID NO: 652 - RNA, 4062 nt, Artificial Sequence
  derived and/or modified CDS sequence (opt3) from MERS-CoV__ALJ54456__S
augauccacagcguguuccugcucauguuucuucugacccccacagaguccuacgucgacguuggcccugauucugugaagucagccugcauugcuguagacauacagcaaacuuucuuugauaaaacguggccaagaccgaucgacgugaguaaggcagaugggauuaucuauccccagggaaggaccuacagcaacauuacaaucacuuaucaggguuuguucccuuaccagggcgaccauggggauauguaugucuacuccgccggacacgcgaccggcacaaccccacaaaaauuauuuguggcuaauuauucucaggacguuaagcaguucgccaacgguuuugugguccggauaggggcagccgcuaauucgacuggaacagugaucauuucacccagcaccagugcaacgauccgcaaaauuuacccugccuucaugcugggcuccucuguaggcaacuuuagcgaugggaagaugggacgauucuuuaaucauacucuaguucuccugccagacgguuguggcacccuucugcgugcuuucuacugcaucuuggaacccagauccgggaaccacuguccugccggaaauucauauacaaguuuugcgacuuaccauaccccagcaacagauugcagcgacggcaacuauaauaggaacgccucucucaauuccuucaaggaguacuucaaccugcggaauuguaccuuuauguauacguacaacauaacugaagaugagauucuggaaugguucgguaucacacagaccgcucaaggggugcaccucuuuucaagccgcuaugucgacuuauacggaggcaauauguuccaguuugccacucugccgguguacgacacaauuaaauauuacaguaucaucccccacucuauuagauccauacagagcgauaggaaggcaugggcugccuucuauguguacaaacuucagccuuugaccuuucugcuagacuucucggucgauggcuauauccggcgcgcgauugacugcggguuuaacgaucucucucaacugcauuguuccuacgagucauucgacguugagaguggaguguauagcguauccucuuuugaagccaagccaagcgguucaguggucgagcaggcagaaggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcugccauagcuagcaauuguuauuccucucucauucuugauuacuucucguauccgcugagcaugaaguccgacuugucagugaguucugccggaccuaucagccaguuuaacuacaaacaguccuucucaaauccaaccugccuaauccuggcaacaguaccccacaaccucacuaccauuacaaagccucugaaauauagcuacaucaauaagugcucuagacuucuguccgaugacaggaccgagguuccccaguuggugaacgccaaucaauauaguccaugugucagcauugugcccucuacugucugggaagacggcgauuacuaccggaaacagcucuccccucuggagggugggggcugguuaguggcuucaggaaguacgguugcgaugacagaacagcugcagaugggcuuugggauaaccgugcaauauggaacugacaccaacagcguaugcccaaagcuagaguucgcaaaugauacaaaaaucgccucgcagcucgguaacugugucgaauacucccuguauggcgugucugggcguggaguuuuucagaauugcaccgcugugggcguccgccagcaaagauucguguacgacgccuaucagaaccuuguagguuacuauagcgaugacgggaacuacuacuguuugagggcaugcgugucaguuccggucagugugauuuaugauaaggagacuaagacacaugccacgcuguuuggcuccguggcuugugagcacaucucuagcaccaugucccaguacucacggagcacucgaaguaugcucaaacgcagagacucuacauauggaccccugcagaccccugucggcugcguucuugggcugguaaauuccagcuuguucguggaagauuguaagcucccacugggacaaucguuaugcgcccugcccgacacaccuucaacucuaaaaccaaggucugugcggaguguccccggugagaugcgccucgcauccaucgcguuuaaccacccgauucagguggaucagcugaauagcucuuacuucaaacuuagcauaccuaccaacuuuuccuucggcguuacgcaagaauauauccagaccacaauucagaaggugacugucgacuguaagcaguacgugugcaauggguuccaaaagugcgagcaguugcugagagaauauggacaguuuuguucaaaaaucaaccaggcucuccauggcgccaaucugaggcaagaugacaguguucguaacuuauucgcaagcgugaagucuucccagucaaguccaauuauccccgguuuugggggcgacuucaaucugacccuuuuggagccuguaagcauauccacaggaucucggucggcccgaagcgcuaucgaggaucuccuguuugacaaagucacuauugccgaucccggcuacaugcagggguacgacgauugcaugcagcaaggaccagcaucagcuagagaccuaaucugugcccaguauguggcgggcuacaaggugcugccuccccucauggaugucaacauggaagccgcuuauaccuccagucugcuugguucuauugcagggguuggauggacggccggcuugagcuccuucgcugccaucccauuugcacagucaauauucuacaggcugaauggugugggcauuacacaacagguauuaucugagaaccagaaacucaucgcgaauaaguuuaaccaggcccugggggcuaugcaaaccggauucacuacaaccaaugaagccuuucgcaaggugcaggacgcagucaacaacaaugcucaggcccuuagcaaacuggcaagugaguuguccaacacuuucggcgccauuagcgcuucuaucggggauauaauccagcggcucgacgugcuggaacaagaugcgcagauugacagacuaaucaauggaaggcugaccacacucaacgccuucguugcacagcagcuggugcgcucagaguccgcugcccuuagugcccaauuggcuaaggauaaagucaaugagugcgugaaggcacagagcaaacgaucgggcuuuuguggucaggggacgcacauuguuucuuucguggucaacgccccgaauggacuguauuuuaugcauguaggcuacuauccuuccaaccacaucgaagugguuagcgcguacgguuuaugcgacgcugccaaucccaccaacuguauagcaccagugaauggcuacuucauuaagacuaacaauacacggaucgucgacgaguggucauauaccgggaguucuuuuuacgcccccgaaccuaucacaucccucaacacuaaguauguggcuccacagguaaccuaccaaaauauuagcacgaaccugcccccuccgcuucugggaaacucaacaggcaucgauuuccaggacgagcuagaugaguuuuucaaaaaugugaguaccagcauuccaaacuuugggucccucacucagauaaauaccacacuguuggaccugacuuaugaaauguuaucucuccaacaggucguuaaggcacugaacgagagcuacaucgaucuuaaagaacugggaaauuauaccuacuacaacaaguggcccugguauauuugguugggcuucaucgccggucucguggcgcuggcucuaugcguguuuuucauucuguguugcacaggguguggaacgaauugcaugggcaaacuuaagugcaaccguuguugcgacagauacgaggaauaugaucucgagccucauaaaguccacgugcacuga

SEQ ID NO: 653 - RNA, 4062 nt, Artificial Sequence
  derived and/or modified CDS sequence (opt3) from MERS-CoV__ALJ54461__S
augauccacagcguguuccugcucauguuucuucugacccccacagaguccuacgucgacguuggcccugauucugugaagccagccugcauugaaguagacauacagcaaacuuucuuugauaaaacguggccgagacccaucgacgugucaaaggcugaugggauuaucuauccucagggaaggaccuacaguaacauuacaaucacuuaucaggguuuguucccauaccagggcgaccauggggauauguaugucuacagcgcaggacacgccaccggcacaacuccccaaaaauuauuuguggcgaauuauucccaggacguuaagcaguucgcuaacgguuuugugguccggauaggggccgcagccaauucuaccggaacagugaucauuucgccuucaaccagcgcuacgauccgcaaaauuuacccagcauucaugcugggcaguuccguaggcaacuuuucugaugggaagaugggacgauucuuuaaucauacucuaguucuccugcccgacgguuguggcacccuucugcgugccuucuacugcaucuuggagccuagaagcgggaaccacuguccagcuggaaauuccuauacaucauuugccacuuaccauaccccggcgacagauugcagugacggcaacuauaauaggaacgcaagccucaauucuuucaaggaauacuucaaccugcggaauuguaccuuuauguauacguacaacauaacugaggaugaaauucuggagugguucgguaucacacagaccgcccaaggggugcaccucuuuuccucacgcuaugucgacuuauacggaggcaauauguuccaguuugcuacucugcccguguacgacacaauuaaauauuacagcaucaucccucacaguauuagaucuauacaguccgauaggaaggccugggcagcuuucuauguguacaaacuucagccauugaccuuucugcuagacuucagcgucgauggcuauauccggcgcgccauugacugcggguuuaacgaucucucgcaacugcauuguucuuacgaguccuucgacguugaaucaggaguguauaguguaagcuccuuugaggcgaagcccucugguagcguggucgaacaggccgagggcguggagugcgauuucucaccucuucugagugggacgccaccccagguuuacaacuuuaaacgauugguguucaccaauuguaacuacaaucucacaaagcuguuaucccuguucagcgucaacgacuuuacuugcucucaaaucucaccggcagcuauagccaguaauuguuauagcucccucauucuugauuacuucucuuauccucugucgaugaaaagcgacuuguccgugaccucagcuggacccaucagucaguuuaacuacaagcagucuuucagcaauccaacaugccuaauccuggccacuguaccucacaaccucaccacaauuaccaagccccugaaauauuccuacaucaauaagugcucaagacuucugagcgaugacaggacugaaguuccacaguuggugaacgcaaaucaauauucucccugugucuccauugugccuaguacggucugggaggacggcgauuacuaccggaaacagcucagcccacuggaaggugggggcugguuaguggccucuggauccacaguugcuaugaccgagcagcugcagaugggcuuugggauaacugugcaauauggaaccgacacaaacucaguaugcccgaagcuagaguucgcgaaugauaccaaaaucgcaagucagcucgguaacugugucgaauacagccuguauggcgugucggggcguggaguuuuucagaauugcacugccgugggcguccgccagcaaagauucguguacgacgcuuaucagaaccuuguagguuacuauuccgaugacgggaacuacuacuguuugagggccugcgugucuguucccgucagcgugauuuaugauaaggagacaaagacgcaugcaacccuguuuggcucaguggccugugaacacaucaguuccacuaugucucaguacagccgguccacacgaucaaugcucaaacgcagagacagcaccuauggaccucugcagacaagugucggcugcguucuugggcuggugaauagcuccuuguucguggaggauuguaagcucccacugggacaaucuuuaugcgcucugcccgacacuccuucgacccuaacgccaaggucaguacggucuguccccggugaaaugcgccucgccaguaucgcauuuaaccacccgauucagguggaucagcuuaauuccagcuacuucaaacuuucuauaccuaccaacuuuagcuucggcguuacacaagaguauauccagacuaccauucagaaggugacagucgacuguaaacaguacgugugcaauggguuccaaaagugcgaacaguugcugagagaguauggacaguuuuguuccaagaucaaccaggcgcuccauggcgcuaaucugaggcaagaugacucaguucguaacuuauucgccagugugaaaagcucucaguccucaccaauuauccccgguuuugggggcgacuucaaucugacucuuuuggagccuguaaguauaagcaccggaucccggucugcacgaucggccaucgaagaucuccuguuugacaaggucacgauugcugaucccggcuacaugcagggguacgacgauugcaugcagcaaggaccagccagcgcaagagaccuaaucugugcucaguauguggccggcuacaaagugcugccuccccucauggaugucaacauggaggcggccuauacaucaucccugcuugguaguauugcugggguuggauggaccgcaggcuugucuagcuucgccgcuaucccauuugcccaguccauauucuacaggcugaauggugugggcauuacucaacagguauuaucagaaaaccagaagcucaucgcaaauaaauuuaaccaggcgcugggggccaugcaaacaggauucaccacuaccaaugaggcuuuucgcaaggugcaggacgccgucaacaacaaugcacaggcucuuucuaagcuggccagcgaauugaguaacacauucggcgcaauuuccgccagcaucggggauauaauccagcggcucgacgugcuggagcaagaugcucagauugacagacuaaucaauggaaggcugacgacccucaacgcguucguugcccagcagcuggugcgcucugagucagcagcucuuuccgcccaauuggccaaagauaaggucaaugaaugcgugaaagcucagaguaagcgaagcggcuuuuguggucaggggacucacauuguuucguucguggucaacgcaccgaauggacuguauuuuaugcauguaggcuacuauccuucuaaccacaucgaggugguuuccgccuacgguuuaugcgacgcggcuaaucccacaaacuguauagccccagugaauggcuacuucauuaaaaccaacaauacacggaucgucgacgaauggagcuauacugggucaaguuuuuacgcacccgagccuaucaccucucucaacacgaaguauguggccccacagguaacauaccaaaauauuuccaccaaccugcccccuccgcuucugggaaacagcacuggcaucgauuuccaggacgagcuagaugaauuuuucaagaaugugucaaccaguauuccaaacuuugggagccucacacagauaaauacuacccuguuggaccugacauaugagauguuaucccuccaacaggucguuaaagcucugaacgaaucuuacaucgaucuuaaggagcugggaaauuauacguacuacaacaaauggcccugguauauuugguugggcuucaucgcaggucucguggcccuggcgcuaugcguguuuuucauucuguguugcaccggguguggaacuaauugcaugggcaagcugaaaugcaaccguuguugcgacagauacgaagaguaugaucucgagccucauaagguccacgugcacuga

SEQ ID NO: 654 - RNA, 4062 nt, Artificial Sequence
  derived and/or modified CDS sequence (opt3) from MERS-CoV__ALJ54468__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuaucugcucacaaauaagucccgcagcuauugccagcaauuguuauuccucucucauccuugauuacuucucguauccgcugagcaugaaguccgacuugucagugaguucugcuggaccuaucagccaguuuaacuacaaacaguccuucucaaaucccacuugccuaauucuggccaccguaccacacaaccucacaacuaucaccaagccucugaaauauagcuacauuaauaagugcucuagacuucuguccgaugacaggacagaaguuccccaguuggugaacgcaaaucaauauaguccaugugucagcauagugcccucuaccgucugggaggacggcgauuacuaccggaaacagcucuccccucuggaaggugggggcugguuaguggccucaggaaguacuguugcuaugacggagcagcugcagaugggcuuugggaucacagugcaauauggaaccgacacuaacagcguaugcccaaagcuagaguucgcgaaugauaccaaaauugcaucgcagcucgguaacugugucgaauacucccuguauggcgugucugggcguggaguuuuucagaauugcacagccgugggcguccgccagcaaagauucguguacgacgcuuaucagaaccuuguagguuacuauagcgaugacgggaacuacuacuguuugagggccugcgugucaguuccggucagugugaucuaugauaaggagaccaagacucaugcaacacuguuuggcuccguggccugugaacacaucucuagcacgaugucccaguacucacggagcacccgaaguaugcucaaacgcagagacucuacuuauggaccccugcagacaccugucggcugcguucuugggcugguaaauuccagcuuguucguggaggauuguaagcucccacugggacaaucguuaugcgcucugcccgacaccccuucaacacuaacuccaaggucugugcggaguguccccggugaaaugcgccucgccuccauugcauuuaaccacccgauacagguggaucagcugaauagcucuuacuucaaacuuagcaucccuaccaacuuuuccuucggcguuacgcaagaguauauucagaccacaauccagaaggugacugucgacuguaaacaguacgugugcaauggguuccaaaagugcgaacaguugcugagagaguauggacaguuuuguucaaagauuaaccaggcgcuccauggcgcuaaucugaggcaagaugacaguguucguaacuuauucgccagcgugaaaucuucccagucaaguccaaucauacccgguuuugggggcgacuucaaucugacccuuuuggagccuguaagcaucuccacaggaucucggucggcacgaagcgccauugaagaucuccuguuugacaaggucacuaucgcugaucccggcuacaugcagggguacgacgauugcaugcagcaaggaccagccucagcaagagaccuaauuugugcucaguauguggccggcuacaaagugcugccuccccucauggaugucaacauggaggcggccuauaccuccagucugcuugguucuaucgcugggguuggauggacggcaggcuugagcuccuucgccgcuauaccauuugcccagucaauuuucuacaggcugaauggugugggcaucacacaacagguauuaucugaaaaccagaagcucauugcaaauaaauuuaaccaggcgcugggggccaugcaaaccggauucacuacaaccaaugaggcuuuucgcaaggugcaggacgccgucaacaacaaugcacaggcucuuagcaagcuggccagugaauuguccaacacuuucggcgcaaucagcgccucuauaggggauaucauucagcggcucgacgugcuggagcaagaugcucagaucgacagacuaauuaauggaaggcugaccacacucaacgcguucguugcccagcagcuggugcgcucagaguccgcagcucuuagugcccaauuggccaaagauaaggucaaugaaugcgugaaagcucagagcaagcgaucgggcuuuuguggucaggggacgcacaucguuucuuucguggucaacgcaccgaauggacuguauuuuaugcauguaggcuacuauccuuccaaccacauagaggugguuagcgccuacgguuuaugcgacgcggcuaaucccaccaacuguauugccccagugaauggcuacuucaucaaaacuaacaauacacggaucgucgacgaauggucauauaccgggaguucuuuuuacgcacccgagccuauuacaucccucaacacuaaguauguggccccacagguaaccuaccaaaauaucagcacgaaccugcccccuccgcuucugggaaacucaacaggcauugauuuccaggacgagcuagaugaauuuuucaagaaugugaguaccagcauaccaaacuuugggucccucacucagaucaauaccacacuguuggaccugacuuaugagauguuaucucuccaacaggucguuaaagcucugaacgaaagcuacauugaucuuaaggagcugggaaauuauaccuacuacaacaaauggcccugguauaucugguugggcuucauugcaggucucguggcccuggcgcuaugcguguuuuucauccuguguugcacaggguguggaacgaauugcaugggcaaacuuaagugcaaccguuguugcgacagauacgaagaguaugaucucgagccucauaagguccacgugcacuga

SEQ ID NO: 655 - RNA, 4062 nt, Artificial Sequence
  derived and/or modified CDS sequence (opt3) from MERS-CoV__ALJ54471__S
augauccacagcguguaccugcucauguuccuucugacccccacagaguccuaugucgacguuggcccugauucugugaagucagccugcauugaaguagacauacagcaaaccuuuuucgauaaaacguggccaagaccgaucgacgugaguaaggcugaugggauuaucuacccccagggaaggaccuauagcaacauuacaaucacuuaccaggguuuguuuccuuaucagggcgaccauggggauauguacgucuauuccgcaggacacgccaccggcacaaccccacaaaaauuauucguggcgaauuacucucaggacguuaagcaguuugcuaacgguuucgugguccggauaggggccgcagccaauucgacuggaacagugaucauuucacccagcaccagugcuacgauccgcaaaauuuacccugcauuuaugcugggcuccucuguaggcaacuucagcgaugggaagaugggacgauuuuucaaucauacucuaguucuccugccagacgguuguggcacccuucugcgugccuuuuauugcaucuuggagcccagauccgggaaccacuguccugcuggaaauucauacacaaguuucgccacuuaucauaccccagcgacagauugcagcgacggcaacuacaauaggaacgcaucucucaauuccuuuaaggaauauuucaaccugcggaauuguaccuucauguacacguauaacauaacugaggaugaaauucuggagugguuugguaucacacagaccgcccaaggggugcaccucuucucaagccgcuacgucgacuuauacggaggcaauauguuucaguucgcuacucugccgguguaugacacaauuaaauacuauaguaucaucccccacucuauuagauccauacagagcgauaggaaggccugggcagcuuuuuacguguauaaacuucagccuuugaccuuccugcuagacuuuucggucgauggcuacauccggcgcgccauugacugcggguucaacgaucucucucaacugcauuguuccuaugagucauuugacguugaaaguggaguguacagcguauccucuuucgaggcgaagccaagcgguucaguggucgaacaggccgagggcguggagugcgauuuuaguccccuucuguccgggacgccuccacagguuuacaacuucaaacgauugguguuuaccaauuguaacuauaaucucacaaagcuguuaagccuguucucugucaacgacuucacuugcucacaaaucagucccgcagcuauagccagcaauuguuacuccucucucauucuugauuauuuuucguacccgcugagcaugaaguccgacuugucagugaguucugcuggaccuaucagccaguucaacuauaaacaguccuuuucaaaucccacuugccuaauccuggccacaguaccacacaaccucacuaccauuacaaagccucugaaauacagcuauaucaauaagugcucuagacuucuguccgaugacaggaccgaaguuccccaguuggugaacgcaaaucaauacaguccaugugucagcauugugcccucuacugucugggaggacggcgauuacuaucggaaacagcucuccccucuggaaggugggggcugguuaguggccucaggaaguacgguugcuaugacagagcagcugcagaugggcuucgggauaaccgugcaauacggaacugacaccaacagcguaugcccaaagcuagaauuugcgaaugauacaaaaaucgcaucgcagcucgguaacugugucgaguauucccuguacggcgugucugggcguggaguuuuccagaauugcaccgccgugggcguccgccagcaaagauuuguguaugacgcuuaccagaaccuuguagguuauuacagcgaugacgggaacuacuauuguuugagggccugcgugucaguuccggucagugugauuuacgauaaggagacuaagacacaugcaacgcuguucggcuccguggccugugaacacaucucuagcaccaugucccaguauucacggagcacucgaaguaugcucaaacgcagagacucuacauacggaccccugcagaccccugucggcugcguucuugggcugguaaauuccagcuuguuuguggaggauuguaagcucccacugggacaaucguuaugcgcucugcccgacacaccuucaacucuaaccccaaggucugugcggaguguccccggugaaaugcgccucgccuccaucgcauucaaccacccgauucagguggaucagcugaauagcucuuauuuuaaacuuagcauaccuacgaacuucuccuuuggcguuacccaagaguacauccagacaacuauucagaaggugaccgucgacuguaaacaguaugugugcaauggguuccaaaagugcgaacaguugcugagagaguacggacaguucuguucaaagaucaaccaggcgcuccauggcgcuaaucugaggcaagaugacaguguucguaacuuauuugccagcgugaaaucuucccagucaaguccaauuauccccgguuucgggggcgacuuuaaucugacacuuuuggagccuguaagcauauccacuggaucucggucggcacgaagcgccaucgaagaucuccuguucgacaaggucaccauugcugaucccggcuacaugcagggguaugacgauugcaugcagcaaggaccagccucagcaagagaccuaaucugugcucaguacguggccggcuauaaagugcugccuccccucauggaugucaacauggaggcggccuacacguccagucugcuugguucuauugcugggguuggauggacagcaggcuugagcuccuuugccgcuaucccauucgcccagucaauauuuuauaggcugaauggugugggcauuacccaacagguauuaucugaaaaccagaagcucaucgcaaauaaauucaaccaggcgcugggggccaugcaaacuggauuuacaaccacuaaugaggcuuuccgcaaggugcaggacgccgucaacaacaaugcacaggcucuuagcaagcuggccagugaauuguccaacaccuuuggcgcaauuagcgccucuaucggggauauaauccagcggcucgacgugcuggagcaagaugcucagauugacagacuaaucaauggaaggcugacaacgcucaacgcguucguugcccagcagcuggugcgcucagaguccgcagcucuuagugcccaauuggccaaagauaaggucaaugaaugcgugaaagcucagagcaagcgaucgggcuucuguggucaggggacccacauuguuucuuuuguggucaacgcaccgaauggacuguacuucaugcauguaggcuauuacccuuccaaccacaucgaggugguuagcgccuacgguuuaugcgacgcggcuaaucccacuaacuguauagccccagugaauggcuauuuuauuaaaacaaacaauacccggaucgucgacgaauggucauacacagggaguucuuucuaugcacccgagccuaucacuucccucaacaccaaguacguggccccacagguaacguaucaaaauauuagcacaaaccugcccccuccgcuucugggaaacucaaccggcaucgauuuucaggacgagcuagaugaguucuuuaagaaugugaguacuagcauuccaaacuucgggucccucacccauauaaauacaacucuguuggaccugaccuacgaaauguuaucucuccagcaagucguuaaagcucugaacgaaagcuauaucgaucuuaaggagcugggaaauuacacauacuauaacaaauggcccugguacauuugguugggcuuuaucgcaggucucguggcccuggcgcuaugcguguucuuuauucuguguugcacgggguguggaaccaauugcaugggcaaacuuaagugcaaccguuguugcgacagauaugaagaguacgaucucgagccucacaagguccacgugcauuga

SEQ ID NO: 656 - RNA, 4062 nt, Artificial Sequence
  derived and/or modified CDS sequence (opt3) from MERS-CoV__ALJ54472__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaguucgcgaaugauacaaaaaucgcaucgcagcucgguaacugugucgaauacucccuguauggcgugucugggcguggaguuuuucagaauugcaccgccgugggcguccuucagcaacgcuucguguacgacgcuuaucagaacuugguagguuacuauagcgaugacgggaacuacuacugucugagagccugcgugucaguuccggucagugugauuuaugauaaggagacuaagacacaugcaacgcucuuuggcuccguggccugugaacacaucucuagcaccaugucccaguacucaaggagcacucggaguaugcugaaacgacgcgacucuacauauggaccccuucagaccccugucggcugcguucugggguugguaaauuccagccucuucguggaggauuguaagcugccauuaggacaaucgcugugcgcucuacccgacacaccuucaacucucgccccaagaucugugaggaguguccccggugaaaugcggcuggcauccaucgcguuuaaccacccgauucagguggaucagcuuaauagcucuuacuucaaauugagcauaccuaccaacuuuuccuucggcguuacgcaagaguauauccagaccacaauucagaaggugacugucgacuguaaacaguacgugugcaauggguuccaaaagugcgaacagcugcuccgcgaguauggacaguuuuguucaaagaucaaccaggcucugcauggcgccaauuuaagacaagaugacaguguuaggaaccuguucgcaagcgugaaaucuucccagucaaguccaauuauccccgguuuugggggcgacuucaaucuuaccuugcucgagccuguaagcauauccacaggaucucguucggcccggagcgcuaucgaagaucugcuauuugacaaggucacuauugccgaucccggcuacaugcagggguacgacgauugcaugcagcaaggaccagcaucagcucgagaccugaucugugcccaguauguggcgggcuacaaagugcucccuccccugauggaugucaacauggaggccgcuuauaccuccagucuuuuggguucuauugcagggguuggauggacggccggccugagcuccuucgcugccaucccauuugcacagucaauauucuacagauuaaauggugugggcauuacacaacagguacucucugaaaaccagaagcugaucgcgaauaaauuuaaccaggcccuuggggcuaugcaaaccggauucacuacaaccaaugaggccuuuaggaaggugcaggacgcagucaacaacaaugcucaggcccugagcaaguuggcaagugaacucuccaacacuuucggcgccauuagcgcuucuaucggggauauaauccagcgccuggacgugcuagagcaagaugcgcagauugaccggcugaucaauggaagacucaccacacugaacgccuucguuucacagcagcuugugagguccgagagugcagcuuugagcgcccaacuggccaaagauaaggucaaugaaugcgugaaagcucagucgaagcgcucuggcuuuuguggucaggggacgcacauuguuuccuucguggucaacgcaccgaauggauuauauuuuaugcauguaggcuacuauccuagcaaccacaucgaggugguuucagccuacggucucugcgacgcggcuaaucccaccaacuguauagccccagugaauggcuacuucauuaaaacuaacaauacacgaaucgucgacgaauggaguuauaccgggucuuccuuuuacgcacccgagccuaucacaagccugaacacuaaguauguggccccacagguaaccuaccaaaauauuucaacgaaccuucccccuccgcugcuaggaaacaguacaggcaucgauuuccaggacgagcucgaugaauuuuucaagaaugugagcaccuccauuccaaacuuugggucucugacucagauaaauaccacauugcuggacuuaacuuaugagaugcucagccugcaacaggucguuaaagcucuuaacgaauccuacaucgaucugaaggaguugggaaauuauaccuacuacaacaaauggcccugguauauuuggcucggcuucaucgcaggucugguggcccuagcgcugugcguguuuuucauucuuuguugcacaggguguggaacgaauugcaugggcaagcucaaaugcaaccgguguugcgaccguuacgaagaguaugaucuggagccucauaagguccacgugcacuga

SEQ ID NO: 657 - RNA, 4062 nt, Artificial Sequence
  derived and/or modified CDS sequence (opt3) from MERS-CoV__ALJ54474__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccaagcacagauugcucugacggcaacuauaauaggaacgcgucccucaauucauucaaggaauacuucaaccugcggaauuguaccuuuauguauacguacaacauaacugaggaugaaauucuggagugguucgguaucacacagaccgcacaaggggugcaccucuuuagcagucgcuaugucgacuuauacggaggcaauauguuccaguuugccacucugccgguguacgacacaauuaaauauuacucuaucaucccccacuccauuagaagcauacagucggauaggaaggcuugggccgcauucuauguguacaaacuucagccuuugaccuuucugcuagacuucucugucgauggcuauauccggcgcgcuauugacugcggguuuaacgaucucucccaacugcauuguucauacgagaguuucgacguugaaagcggaguguauuccguaucuagcuuugaggccaagccaucagguaguguggucgaacaggcggagggcguggagugcgauuucagcccccuucuguccgggacgccuccacagguuuacaacuuuaaacgauugguguucaccaauuguaacuacaaucucacaaagcuguuaucucuguucucagucaacgacuuuacuugcagucaaaucagccccgccgcaauagcuuccaauuguuauucuucgcucauucuugauuacuucagcuauccgcuguccaugaagucagacuugagugugucuagcgccggaccuaucucccaguuuaacuacaaacagucauucagcaauccaaccugccuaauccuggcuacaguaccccacaaccucacuaccauuacaaagccucugaaauauucuuacaucaauaagugcuccagacuucugagugaugacaggaccgaaguuccccaguuggugaacgccaaucaauauagcccaugugucucuauugugcccuccacugucugggaggacggcgauuacuaccggaaacagcucucaccucuggaaggugggggcugguuaguggcaaguggaagcacgguugccaugacagagcagcugcagaugggcuuugggauaaccgugcaauauggaacugacaccaacucgguaugcccaaagcuagaguucgcuaaugauacaaaaaucgcgucccagcucgguaacugugucgaauacucucuguauggcgugagcgggcguggaguuuuucagaauugcaccgcagugggcguccgccagcaaagauucguguacgacgccuaucagaaccuuguagguuacuauucagaugacgggaacuacuacuguuugagggcuugcgugaguguuccggucuccgugauuuaugauaaggagacuaagacacaugccacgcuguuuggcucuguggcaugugaacacaucagcuccaccaugucacaguacagccggaguacucgaucuaugcucaaacgcagagacuccacauauggaccccugcagaccccugucggcugcguucuugggcuggugaauagcucguuguucguggaggauuguaagcucccacugggacaaucauuaugcgcccugcccgacacaccuucuacucuaaccccaaggaguguacgguccguccccggugaaaugcgccucgcuagcaucgccuuuaaccacccgauucagguggaucagcuuaauucuagcuacuucaaacuuuccauaccuacgaacuuuucauucggcguuacccaagaguauauccagacaacuauucagaaggugaccgucgacuguaaacaguacgugugcaauggguuccaaaagugcgaacaguugcugagagaguauggacaguuuuguaguaagaucaaccaggcacuccauggcgcgaaucugaggcaagaugacagcguucguaacuuauucgcuucugugaaauccucacagaguagcccaauuauccccgguuuugggggcgacuucaaucugacacuuuuggagccuguauccauaucuacuggaucgcggagcgcccgaucagcaaucgaagaucuccuguuugacaaggucaccauugccgaucccggcuacaugcagggguacgacgauugcaugcagcaaggaccagcuuccgccagagaccuaaucugugcacaguauguggcuggcuacaaagugcugccuccccucauggaugucaacauggaggccgcguauacgaguucucugcuugguagcauugccgggguuggauggacagcuggcuuguccucauucgcagccaucccauuugcucagucuauauucuacaggcugaauggugugggcauuacccaacagguauuaagcgaaaaccagaagcucaucgccaauaaauuuaaccaggcacugggggcgaugcaaacuggauucacaaccacuaaugaggccuuucgcaaggugcaggacgcugucaacaacaaugcccaggcacuuaguaagcuggcuuccgaauugagcaacaccuucggcgccauuucugcaucaaucggggauauaauccagcggcucgacgugcuggagcaagaugcccagauugacagacuaaucaauggaaggcugacaacgcucaacgcuuucguugcgcagcagcuggugcgcuccgagagugccgcacuuagcgcucaauuggccaaagauaaggucaaugaaugcgugaaagcccagucgaagcgaucuggcuuuuguggucaggggacccacauuguuuccuucguggucaacgcuccgaauggacuguauuuuaugcauguaggcuacuauccuagcaaccacaucgaggugguuucagcauacgguuuaugcgacgccgcgaaucccacuaacuguauagcuccagugaauggcuacuucauuaaaacaaacaauacccgggucguggacgaauggaguuauacagggucuuccuuuuacgcccccgagccuaucacuagccucaacaccaaguauguagcaccacaggugacguaccaaaauaucucaacaaaccugcccccuccgcuucugaguaacagcaccggaauugauuuccaggacgagcuagaugaauuuuucaagaaugucuccacuucuaucccaaacuuuggcagccucacccagauuaauacaacucuguuggaccugaccuaugagauguuaucccuccaacagguugugaaagcccugaacgaaucauacauagaucuuaaggagcuggggaauuauacauacuacaacaaauggcccugguauaucugguugggauucauugcuggccucguggcacuggcccuaugcgucuuuuucauccuguguugcacggguugugggaccaauugcaugggaaagcugaaaugcaaccguuguugcgacagauacgaagaguaugaucucgagccucauaaggugcacguucacuga

SEQ ID NO: 658 - RNA, 4062 nt, Artificial Sequence
  derived and/or modified CDS sequence (opt3) from MERS-CoV__ALJ54483__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucuuucaguucaacuacaaacagagcuuuuccaauccaaccugccuaauccuggccacaguaccccacaaccucacuaccauuacaaagccucugaaauauucauacaucaauaagugcagcagacuucugucugaugacaggaccgaaguuccccaguuggugaacgcaaaucaauauuccccaugugucaguauugugcccagcacugucugggaggacggcgauuacuaccggaaacagcucucuccucuggaaggugggggcugguuaguggccuccggaucaacgguugcuaugacagagcagcugcagaugggcuucgggauaaccgugcaauauggaacugacaccaacaguguaugcccaaagcuagaauuugcgaaugauacaaaaaucgcaagccagcucgguaacugugucgaguacucgcuguauggcguguccgggcguggaguuuuccagaauugcaccgccgugggcguccgccagcaaagauuuguguacgacgcuuaucagaaccuuguagguuacuauucugaugacgggaacuacuacuguuugagggccugcgugagcguuccggucucagugauuuaugauaaggagacuaagacacaugcaacgcuguucggcaguguggccugugaacacaucuccucuaccaugagccaguacucccggucaacucgaagcaugcucaaacgcagagacaguacauauggaccccugcagaccccugucggcugcguucuugggcugguaaauucuuccuuguuuguggaggauuguaagcucccacugggacaaaguuuaugcgcucugcccgacacaccuucgacucuaaccccaaggucagugcggucuguccccggugaaaugcgccucgccaguaucgcauucaaccacccgauucagguggaucagcuuaauuccagcuacuuuaaacuuucuauaccuacgaacuucagcuucggcguuacccaagaguauauccagacaacuauucagaaggugaccgucgacuguaaacaguacgugugcaauggguuucaaaagugcgaacaguugcugagagaguauggacaguucuguuccaagaucaaccaggcgcuccauggcgcuaaucugaggcaagaugacucaguucguaacuuauuugccagugugaaaagcucucaguccucaccaauuauccccgguuucgggggcgacuuuaaucugacacuuuuggagccuguaaguauaagcacuggaucccggucugcacgaucggccaucgaagaucuccuguucgacaaggucaccauugcugaucccggcuacaugcagggguacgacgauugcaugcagcaaggaccagccagcgcaagagaccuaaucugugcucaguauguggccggcuacaaagugcugccuccccucauggaugucaacauggaggcggccuauacgucaucccugcuugguaguauugcugggguuggauggacagcaggcuugucuagcuuugccgcuaucccauucgcccaguccauauuuuacaggcugaauggugugggcauuacccaacagguauuaucagaaaaccagaagcucaucgcaaauaaauucaaccaggcgcugggggccaugcaaacuggauuuacaaccacuaaugaggcuuuccgcaaggugcaggacgccgucaacaacaaugcacaggcucuuucuaagcuggccagcgaauugaguaacaccuucggcgcaauuuccgccagcaucggggauauaauccagcggcucgacgugcuggagcaagaugcucagauugacagacuaaucaauggaaggcugacaacgcucaacgcguuuguugcccagcagcuggugcgcucugagucagcagcucuuuccgcccaauuggccaaagauaaggucaaugaaugcgugaaagcucagaguaagcgaagcggcuucuguggucaggggacccacauuguuucguuuguggucaacgcaccgaauggacuguauuucaugcauguaggcuacuauccuucuaaccacaucgaggugguuuccgccuacgguuuaugcgacgcggcuaaucccacuaacuguauagccccagugaauggcuacuuuauuaaaacaaacaauacccggaucgucgacgaauggagcuauacagggucaaguuucuacgcacccgagccuaucacuucucucaacaccaaguauguggccccacagguaacguaccaaaauauuuccacaaaccugcccccuccgcuucugggaaacagcaccggcaucgauuuucaggacgagcuagaugaguucuuuaagaaugugucaacuagcauuccaaacuucgggagccucacccagauaaauacaacucuguuggaccugaccuaugaaauguuaucccuccaacaggucguuaaagcucugaacgaaucuuacaucgaucuuaaggagcugggaaauuauacauacuacaacaaauggcccugguauauuugguugggcuuuaucgcaggucucguggcccuggcgcuaugcguguucuuuauucuguguugcacgggguguggaaccaauugcaugggcaagcugaaaugcaaccguuguugcgacagauacgaagaguaugaucucgagccucauaagguccacgugcacuga

SEQ ID NO: 659 - RNA, 4062 nt, Artificial Sequence
  derived and/or modified CDS sequence (opt3) from MERS-CoV__ALJ54486__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauagguacgcaucucucaacuccuucaaggaauauuucaaucugcggaacuguaccuuuauguacacguauaauauaacugaggaugaaauucuggagugguucgguaucacacagaccgcccaaggggugcaccucuuuucaagccgcuacgucgacuuauacggaggcaacauguuccaguuugcuacucugccgguguaugacacaauuaaauacuauaguaucaucccccacucuauuagauccauacagagcgauaggaaggccugggcagcuuucuacguguauaaacuucagccuuugaccuuucugcuagacuucucggucgauggcuacauccggcgcgccauugacugcggguuuaaugaucucucucaacugcauuguuccuaugagucauucgacguugaaaguggaguguacagcguauccucuuuugaggcgaagccaagcgguucaguggucgaacaggccgagggcguggagugcgauuucaguccccuucuguccgggacgccuccacagguuuacaacuuuaaacgauugguguucaccaacuguaauuauaaccucacaaagcuguuaagccuguucucugucaaugacuuuacuugcucacaaaucagucccgcagcuauagccagcaacuguuacuccucucucauucuugauuauuucucguacccgcugagcaugaaguccgacuugucagugaguucugcuggaccuaucagccaguuuaauuauaaacaguccuucucaaacccaaccugccuaauccuggccacaguaccccacaaucucacuaccauuacaaagccucugaaauacagcuauaucaacaagugcucuagacuucuguccgaugacaggaccgaaguuccccaguuggugaaugcaaaccaauacaguccaugugucagcauugugcccucuacugucugggaggacggcgauuacuaucggaaacagcucuccccucuggaaggugggggcugguuagugguuucaggaaguacgguggccaugacagagcagcugcagaugggcuuugggauaaccguacaauacggaacugacaccaauagcgucugcccaaagcuagaguucgcuaacgauacaaaaaucgcgucgcagcucgguaauuguguggaauauucccuguacggcguuucugggcguggaguguuucagaacugcaccgcagucggcgugcgccagcaaagauucguauaugacgccuaccagaaucuuguggguuauuacagcgaugacgggaacuacuauuguuugagggcuugcguuucagucccggugagugugauuuacgauaaggagacuaagacacaugccacgcuguuuggcuccgucgcaugugaacacaucucuagcaccaugucccaguauucacggagcacucgaaguaugcucaaacgcagagacucuacauacggaccccugcagaccccuguuggcugcgugcuugggcuggugaacuccagcuuguucguagaggauuguaagcucccacugggacaaucguuaugcgcccugcccgacacaccuucaacucuaaccccaaggucuguccggagugugcccggugaaaugcgccucgcuuccaucgccuuuaaucacccgauucagguugaucagcugaacagcucuuauuucaaacuuagcauaccuacgaauuuuuccuucggcgugacccaagaguacauccagacaacuauucagaaggucaccguggacuguaaacaguauguuugcaacggguuccaaaagugcgaacaguugcugagagaguacggacaguuuuguucaaagaucaaucaggcacuccauggcgcgaaccugaggcaagaugacagugugcguaauuuauucgcuagcguaaaaucuucccagucaaguccaauuauccccgguuuugggggcgacuucaaccugacacuuuuggagccugucagcauauccacuggaucucggucggcccgaagcgcaaucgaagaucuccuguuugacaaggugaccauugccgaucccggcuacaugcagggguaugacgauugcaugcagcaaggaccagcuucagccagagaccuaaucugugcacaguacguggcuggcuauaaaguccugccuccccucauggauguuaauauggaggccgcguacacguccagucugcuugguucuauugccggggugggauggacagcuggcuugagcuccuucgcagccaucccauuugcucagucaauauucuauaggcugaacgguguaggcauuacccaacagguguuaucugaaaaucagaagcucaucgccaacaaauuuaaucaggcacugggggcgaugcaaacuggauucacaaccacuaacgaggccuuucgcaagguccaggacgcugugaauaacaacgcccaggcacuuagcaagcuggcuagugaauuguccaauaccuucggcgccauuagcgcaucuaucggggauauaauccagcggcucgacguucuggagcaagaugcccagauugacagacuaaucaacggaaggcugacaacgcucaaugcuuucguggcgcagcagcugguccgcucagaguccgccgcacuuagugcucaauuggccaaagauaaggugaacgaaugcguuaaagcccagagcaagcgaucgggcuuuuguggucaggggacccacauugugucuuucgucguaaaugcuccgaacggacuguacuuuaugcaugugggcuauuacccuuccaaucacaucgagguugugagcgcauacgguuuaugcgacgccgcgaaccccacuaauuguauagcuccagucaacggcuauuucauuaaaacaaauaacacccggaucguggacgaauggucauacacagggaguucuuuuuaugcccccgagccuaucacuucccucaauaccaaguacguagcaccacaggugacguaucaaaacauuagcacaaaucugcccccuccgcuucugucaaacaguaccggaaucgauuuccaggacgagcuagaugaauuuuucaagaacgucagcacuuccauuccaaauuuuggcucucucacccagauaaacacaacucuguuggaccugaccuacgagauguuaagccuccaacagguugugaaagcccugaaugaauccuauaucgaucuuaaggagcuggggaacuacacauacuauaauaaauggcccugguacauuugguugggauucaucgcuggccucguggcacuggcccuaugcgucuuuuucauucuguguugcacggguugugggaccaacugcaugggaaaacuuaagugcaaucguuguugcgacagauaugaagaguacgaucucgagccucauaaggugcacguucacuga

SEQ ID NO: 660 - RNA, 4062 nt, Artificial Sequence
  derived and/or modified CDS sequence (opt3) from MERS-CoV__ALJ54488__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauauaugucuacuccgcaggacacgccaccggcacaaccccacaaaaauuauuuguggcgaauuauucucaggacguuaagcaguucgcuaacgguuuugugguccggaucggggccgcagccaauucgacuggaacagugauuaucucacccagcaccagugcuacgauucgcaaaaucuacccugcauucaugcugggcuccucuguaggcaacuuuagcgaugggaagaugggacgauucuuuaaucauacucuaguucuccugccagacgguuguggcacccuucugcgugccuucuacugcauauuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauuacugaggaugaaauccuggagugguucgguauuacacagaccgcccaaggggugcaccucuuuucaagccgcuaugucgacuuauacggaggcaauauguuccaguuugcuacucugccgguguacgacacaaucaaauauuacaguaucauuccccacucuauaagauccauccagagcgauaggaaggccugggcagcuuucuauguguacaaacuucagccuuugaccuuucugcuagacuucucggucgauggcuauauucggcgcgccaucgacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaauaagucccgcagcuauugccagcaauuguuauuccucucucauccuugauuacuucucguauccgcugagcaugaaguccgacuugucagugaguucugcuggaccuaucagccaguuuaacuacaaacaguccuucucaaauccaaccugccuaauucuggccacaguaccccacaaccucacuaccaucacaaagccucugaaauauagcuacauuaauaagugcucuagacuucuguccgaugacaggaccgaaguuccccaguuggugaacgcaaaucaauauaguccaugugucagcauagugcccucuacugucugggaggacggcgauuacuaccggaaacagcucuccccucuggaaggugggggcugguuaguggccucaggaaguacgguugcuaugacagagcagcugcagaugggcuuugggaucaccgugcaauauggaacugacaccaacagcguaugcccaaagcuagaguucgcgaaugauacaaaaauugcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugaucuaugauaaggagacuaagacacaugcaacgcuguuuggcuccguggccugugaacacaucucuagcaccaugucccaguacucacggagcacucgaaguaugcucaaacgcagagacucuacauauggaccccugcagaccccugucggcugcguucuugggcugguaaauuccagcuuguucguggaggauuguaagcucccacugggacaaucguuaugcgcucugcccgacacaccuucaacucuaaccccaaggucugugcggaguguccccggugaaaugcgccucgccuccauugcauuuaaccacccgauacagguggaucagcugaauagcucuuacuucaaacuuagcaucccuacgaacuuuuccuucggcguuacccaagaguauauucagacaacuauccagaaggugaccgucgacuguaaacaguacgugugcaauggguuccaaaagugcgaacaguugcugagagaguauggacaguuuuguucaaagauuaaccaggcgcuccauggcgcuaaucugaggcaagaugacaguguucguaacuuauucgccagcgugaaaucuucccagucaaguccaaucauacccgguuuugggggcgacuucaaucugacacuuuuggagccuguaagcaucuccacuggaucucggucggcacgaagcgccauugaagaucuccuguuugacaaggucaccaucgcugaucccggcuacaugcagggguacgacgauugcaugcagcaaggaccagccucagcaagagaccuaauuugugcucaguauguggccggcuacaaagugcugccuccccucauggaugucaacauggaggcggccuauacguccagucugcuugguucuaucgcugggguuggauggacagcaggcuugagcuccuucgccgcuauaccauuugcccagucaauuuucuacaggcugaauggugugggcaucacccaacagguauuaucugaaaaccagaagcucauugcaaauaaauuuaaccaggcgcugggggccaugcaaacuggauucacaaccacuaaugaggcuuuucgcaaggugcaggacgccgucaacaacaaugcacaggcucuuagcaagcuggccagugaauuguccaacaccuucggcgcaaucagcgccucuauaggggauaucauucagcggcucgacgugcuggagcaagaugcucagaucgacagacuaauuaauggaaggcugacaacgcucaacgcguucguugcccagcagcuggugcgcucagaguccgcagcucuuagugcccaauuggccaaagauaaggucaaugaaugcgugaaagcucagagcaagcgaucgggcuuuuguggucaggggacccacaucguuucuuucguggucaacgcaccgaauggacuguauuuuaugcauguaggcuacuauccuuccaaccacauagaggugguuagcgccuacgguuuaugcgacgcggcuaaucccacuaacuguauugccccagugaauggcuacuucaucaaaacaaacaauacccggaucgucgacgaauggucauauacagggaguucuuuuuacgcacccgagccuauuacuucccucaacaccaaguauguggccccacagguaacguaccaaaauaucagcacaaaccugcccccuccgcuucugggaaacucaaccggcauugauuuccaggacgagcuagaugaauuuuucaagaaugugaguacuagcauaccaaacuuugggucccucacccagaucaauacaacucuguuggaccugaccuaugagauguuaucucuccaacaggucguuaaagcucugaacgaaagcuacauugaucuuaaggagcugggaaauuauacauacuacaacaaauggcccugguauaucugguugggcuucauugcaggucucguggcccuggcgcuaugcguguuuuucauccuguguugcacgggguguggaaccaauugcaugggcaaacuuaagugcaaccguuguugcgacagauacgaagaguaugaucucgagccucauaagguccacgugcacuga

SEQ ID NO: 661 - RNA, 4062 nt, Artificial Sequence
  derived and/or modified CDS sequence (opt3) from MERS-CoV__ALJ54490__S
augauccacagcguguuccugcucauguuucuucugacccccacagaguccuacgucgacguuggcccugauucugugaagucagccugcauugcuguagacauacagcaaacuuucuuugauaaaacguggccaagaccgaucgacgugaguaaggcagaugggauuaucuauccccagggaaggaccuacagcaacauuacaaucacuuaucaggguuuguucccuuaccagggcgaccauggggauauguaugucuacuccgccggacacgcgaccggcacaaccccacaaaaauuauuuguggcuaauuauucucaggacguuaagcaguucgccaacgguuuugugguccggauaggggcagccgcuaauucgacuggaacagugaucauuucacccagcaccagugcaacgauccgcaaaauuuacccugccuucaugcugggcuccucuguaggcaacuuuagcgaugggaagaugggacgauucuuuaaucauacucuaguucuccugccagacgguuguggcacccuucugcgugcuuucuacugcaucuuggaacccagauccgggaaccacuguccugccggaaauucauauacaaguuuugcgacuuaccauaccccagcaacagauugcagcgacggcaacuauaauaggaacgccucucucaauuccuucaaggaguacuucaaccugcggaauuguaccuuuauguauacguacaacauaacugaagaugagauucuggaaugguucgguaucacacagaccgcucaaggggugcaccucuuuucaagccgcuaugucgacuuauacggaggcaauauguuccaguuugccacucugccgguguacgacacaauuaaauauuacaguaucaucccccacucuauuagauccauacagagcgauaggaaggcaugggcugccuucuauguguacaaacuucagccuuugaccuuucugcuagacuucucggucgauggcuauauccggcgcgcgauugacugcggguuuaacgaucucucucaacugcauuguuccuacgagucauucgacguugagaguggaguguauagcguauccucuuuugaagccaagccaagcgguucaguggucgagcaggcagaaggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcugccauagcuagcaauuguuauuccucucucauucuugauuacuucucguauccgcugagcaugaaguccgacuugucagugaguucugccggaccuaucagccaguuuaacuacaaacaguccuucucaaauccaaccugccuaauccuggcaacaguaccccacaaccucacuaccauuacaaagccucugaaauauagcuacaucaauaagugcucuagacuucuguccgauggcaggaccgagguuccccaguuggugaacgccaaucaauauaguccaugugucagcauugugcccucuacugucugggaagacggugacuacuaccggaaacagcucuccccucuggaagggggcggaugguuaguggcuucaggcaguacgguugcgaugacagagcagcugcagaugggguuuggaauaaccgugcaauaugguacugauaccaacagcguaugcccaaagcuagaguucgcaaaugacacaaaaaucgccucgcagcucggcaacugugucgaauacucccuguauggggugucuggacguggcguuuuucagaauugcaccgcuguggguguccgccagcaaagauucguguacgaugccuaucagaaccuuguaggguacuauagcgacgauggcaacuacuacuguuugagggcaugcgugucaguuccggucagugugauuuaugacaaggagacuaagacacaugccacgcuguuuggauccguggcuugugagcacaucucuagcaccaugucccaguacucacggagcacucgaaguaugcucaaacgcagagauucuacauauggcccccugcagaccccugucgggugcguucuuggacugguaaauuccagcuuguucguggaagacuguaagcucccacugggucaaucguuaugcgcccugcccgauacaccuucaacucuaaaaccaaggucugugcggaguguccccggcgagaugcgccucgcauccaucgcguuuaaccacccgauucagguggaccagcugaauagcucuuacuucaaacuuagcauaccuaccaacuuuuccuucgggguuacgcaagaauauauccagaccacaauucagaaggugacugucgauuguaagcaguacgugugcaauggauuccaaaagugcgagcaguugcugagagaauauggccaguuuuguucaaaaaucaaccaggcucuccauggugccaaucugaggcaagacgauaguguucguaacuuauucgcaagcgugaagucuucccagucaaguccaauuauccccggguuuggcggagacuucaaucugacccuuuuggagccuguaagcauauccacaggcucucggucggcccgaagcgcuaucgaggaccuccuguuugauaaagucacuauugccgaccccggguacaugcagggauacgaugacugcaugcagcaaggcccagcaucagcuagagaucuaaucugugcccaguauguggcggguuacaaggugcugccuccccucauggacgucaacauggaagccgcuuauaccuccagucugcuugggucuauugcaggaguuggcuggacggccgguuugagcuccuucgcugccaucccauuugcacagucaauauucuacaggcugaauggcguggggauuacacaacagguauuaucugagaaccagaaacucaucgcgaauaaguuuaaccaggcccugggagcuaugcaaaccggcuucacuacaaccaaugaagccuuucgcaaggugcaggaugcagucaacaacaaugcucaggcccuuagcaaacuggcaagugaguuguccaacacuuucggggccauuagcgcuucuaucggagacauaauccagcggcucgaugugcuggaacaagacgcgcagauugauagacuaaucaauggcaggcugaccacacucaacgccuucguugcacagcagcuggugcgcucagaguccgcugcccuuagugcccaauuggcuaaggacaaagucaaugagugcgugaaggcacagagcaaacgaucggguuuuugugggcagggaacgcacauuguuucuuucguggucaacgccccgaauggccuguauuuuaugcauguagguuacuauccuuccaaccacaucgaagugguuagcgcguacggcuuaugcgaugcugccaaucccaccaacuguauagcaccagugaauggguacuucauuaagacuaacaauacacggaucgucgacgaguggucauauaccggaaguucuuuuuacgcccccgaaccuaucacaucccucaacacuaaguauguggcuccacagguaaccuaccaaaauauuagcacgaaccugcccccuccgcuucugggcaacucaacagggaucgacuuccaggaugagcuagacgaguuuuucaaaaaugugaguaccagcauuccaaacuuuggaucccucacucagauaaauaccacacuguuggaucugacuuaugaaauguuaucucuccaacaggucguuaaggcacugaacgagagcuacaucgaccuuaaagaacugggcaauuauaccuacuacaacaaguggcccugguauauuugguuggguuucaucgccgggcucguggcgcuggcucuaugcguguuuuucauucuguguugcacaggauguggcacgaauugcauggguaaacuuaagugcaaccguuguugcgauagauacgaggaauaugaccucgagccucauaaaguccacgugcacuga

SEQ ID NO: 662 - RNA, 4062 nt, Artificial Sequence
  derived and/or modified CDS sequence (opt3) from MERS-CoV__ALJ54495__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuagugguuucaggaaguacgguggccaugacagagcagcugcagaugggcuuugggauaaccguacaauauggaacugacaccaacagcgucugcccaaagcuagaguucgcuaaugauacaaaaaucgcgucgcagcucgguaacuguguggaauacucccuguauggcguuucugggcguggaguguuucagaauugcaccgcagucggcgugcgccagcaaagauucguauacgacgccuaucagaaccuuguggguuacuauagcgaugacgggaacuacuacuguuugagggcuugcguuucagucccggugagugugauuuaugauaaggagacuaagacacaugccacgcuguuuggcuccgucgcaugugaacacaucucuagcaccaugucccaguacucacggagcacucgaaguaugcucaaacgcagagacucuacauauggaccccugcagaccccuguuggcugcgugcuugggcugguaaauuccagcuuguucguggaggauuguaagcucccacugggacaaucguuaugcgcccugcccgacacaccuucaacucuaaccccaaggucuguccggagugugcccggugaaaugcgccucgcuuccaucgccuuuaaccacccgauucagguugaucagcugaauagcucuuacuucaaacuuagcauaccuacgaacuuuuccuucggcgugacccaagaguauauccagacaacuauucagaaggucaccguggacuguaaacaguacguuugcaauggguuccaaaagugcgaacaguugcugagagaguauggacaguuuuguucaaagaucaaccaggcacuccauggcgcgaaucugaggcaagaugacagugugcguaacuuauucgcuagcguaaaaucuucccagucaaguccaauuauccccgguuuugggggcgacuucaaucugacacuuuuggagccugucagcauauccacuggaucucggucggcccgaagcgcaaucgaagaucuccuguuugacaaggugaccauugccgaucccggcuacaugcagggguacgacgauugcaugcagcaaggaccagcuucagccagagaccuaaucugugcacaguauguggcuggcuacaaaguccugccuccccucauggauguuaacauggaggccgcguauacguccagucugcuugguucuauugccggggugggauggacagcuggcuugagcuccuucgcagccaucccauuugcucagucaauauucuacaggcugaaugguguaggcauuacccaacagguguuaucugaaaaccagaagcucaucgccaauaaauuuaaccaggcacugggggcgaugcaaacuggauucacaaccacuaaugaggccuuucgcaagguccaggacgcugugaacaacaaugcccaggcacuuagcaagcuggcuagugaauuguccaacaccuucggcgccauuagcgcaucuaucggggauauaauccagcggcucgacguucuggagcaagaugcccagauugacagacuaaucaauggaaggcugacaacgcucaacgcuuucguggcgcagcagcugguccgcucagaguccgccgcacuuagugcucaauuggccaaagauaaggugaaugaaugcguuaaagcccagagcaagcgaucgggcuuuuguggucaggggauucacaucgugucuuucgucguaaacgcuccgaauggacuguauuuuaugcaugugggcuacuauccuuccaaccacauagagguugugagcgcauacgguuuaugcgacgccgcgaaucccaccaacuguauugcuccagucaauggcuacuucaucaaaacuaacaauacacggaucguggacgaauggucauauaccgggaguucuuuuuacgcccccgagccuauuacaucccucaacacuaaguauguagcaccacaggugaccuaccaaaauaucagcacgaaccugcccccuccgcuucugggaaacucaacaggcauugauuuccaggacgagcuagaugaauuuuucaagaaugucaguaccagcauaccaaacuuugggucccucacucagaucaauaccacacuguuggaccugacuuaugagauguuaucucuccaacagguugugaaagcccugaacgaaagcuacauugaucuuaaggagcugggaaauuauaccuacuacaacaaauggcccugguauaucugguugggcuucauugcuggucucguggcacuggcccuaugcgucuuuuucauccuguguugcacaggguguggaacgaauugcaugggcaaacuuaagugcaaccguuguugcgacagauacgaagaguaugaucucgagccucauaaggugcacguucacuga

SEQ ID NO: 663 - RNA, 4062 nt, Artificial Sequence
  derived and/or modified CDS sequence (opt3) from MERS-CoV__ALJ54496__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucccuccgaugacaggaccgaaguuccacagcuggugaacgcaaaucaauauagucccugugucagcauugugccuucuacugucugggaggacggcgauuacuaccggaaacaguuguccccacucgaaggugggggcuggcugguggccucaggaaguacgguugcuaugacagagcaguuacagaugggcuuugggauaaccgugcaauauggaacugacaccaacagcguaugcccgaagcuggaguucgcgaaugauacaaaaaucgcaucgcagcuagguaacugugucgaauacucccucuauggcgugucugggcguggaguuuuucagaauugcaccgccgugggcguccgccagcaaagauucguguacgacgcuuaucagaaccugguagguuacuauagcgaugacgggaacuacuacugucuuagggccugcgugucaguucccgucagugugauuuaugauaaggagacuaagacacaugcaacguuguuuggcuccguggccugugaacacaucucuagcaccaugucccaguacucacggagcacucgaaguaugcugaaacgcagagacucuacauauggaccucuccagaccccagucggcugcguucuggggcuuguaaauuccagccuguucguggaggauuguaaguugccccucggacaaucgcugugcgcuuuaccugacacaccaucaacucugacccccaggucugugcggagugucccgggugaaaugcgccuagccuccaucgcauuuaaccacccuauucagguggaucagcucaauagcucuuacuucaaacugagcauaccaacgaacuuuuccuucggcguuacccaagaguauauccagacaacuauucagaaggugaccgucgacuguaaacaguacgugugcaauggguuccaaaagugcgaacagcuuuugagagaguauggacaguuuuguucaaagaucaaccaggcgcugcauggcgcuaaucucaggcaagaugacaguguucguaaccuguucgccagcgugaaaucuucccagucaagucccauuaucccugguuuugggggcgacuucaauuuaacacugcuugagcccguaagcauauccacuggaucucggucggcacgaagcgccaucgaagauuugcucuuugacaaggucaccauugcugauccaggcuacaugcagggguacgacgauugcaugcagcaaggaccugccucagcaagagaccugaucugugcucaguauguggccggcuacaaagugcuacccccacugauggaugucaacauggaggcggccuauacguccagucuccuggguucuauugcugggguuggauggacagcaggccuuagcuccuucgccgcuaucccguuugcccagucaauauucuacagguugaauggugugggcauuacccaacagguacugucugaaaaccagaaguuaaucgcaaauaaauuuaaccaggcgcucggggccaugcaaacuggauucacaaccacuaaugaggcuuuucgcaaggugcaggacgccgucaacaacaaugcacaggcucugagcaaacuugccagugaacuguccaacaccuucggcgcaauuagcgccucuaucggggauauaauccagcgguuggacgugcucgagcaagaugcucagauugacagacugaucaauggaaggcuaacaacgcugaacgcguucguugcccagcagcucgugcgcucagaguccgcagcucugagugcccaacuugccaaggauaaggucaaugaaugcgugaaagcucagagcaagcgaucgggcuuuuguggucaggggacccacauuguuucuuucguggucaacgcaccuaauggauuguauuuuaugcauguaggcuacuaucccuccaaccacaucgaggugguuagcgccuacggucugugcgacgcggcuaauccaacuaacuguauagcccccgugaauggcuacuucauuaaaacaaacaauacccggaucgucgacgauuggucauauacagggaguucuuuuuacgcaccugaaccaaucacuuccuuaaacaccaaguauguggcuccccagguaacguaccaaaauauuagcacaaaccucccuccgccacugcuuggaaacucaaccggcaucgacuuccaggaugagcuggacgaguuuuucaagaaugugaguacuagcauucccaacuuugggucccuaacccagauaaauacaacucuccuggauuugaccuaugaaaugcugucuuuacaacaggucguuaaagcccucaacgagagcuacaucgaccugaaggaacuuggaaauuauacauacuacaacaaauggccuugguauauuuggcugggcuucaucgcagguuugguggcccucgcgcugugcguguuuuucauucuauguugcacgggguguggaaccaauugcaugggcaagcugaaaugcaaccguuguugcgauagauacgaggaauaugaccuugagccacauaagguccacgugcacuga

SEQ ID NO: 664 - RNA, 4062 nt, Artificial Sequence
  derived and/or modified CDS sequence (opt3) from MERS-CoV__ALJ54500__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucagucuucuguuguccgggacgcccccucagguuuacaacuuuaaacgacucguguucaccaauuguaacuacaaucugacaaaguuacugagccucuucucugucaacgacuuuacuugcucacaaaucaguccagcagcuauagccagcaauuguuauuccucucuuauucuggauuacuucucguaucccuugagcaugaaguccgaccuaucagugaguucugcuggaccgaucagccaguuuaacuacaaacaguccuucucaaauccuaccugccugauccucgccacaguaccccacaaccugacuaccauuacaaagccacuuaaauauagcuacaucaauaagugcucuagacuguuguccgaugacaggaccgaaguuccucagcucgugaacgcaaaucaauauagucccugugucagcauugugccaucuacugucugggaggacggcgauuacuaccggaaacagcugucccccuuagaaggugggggcuggcugguggccucaggaaguacgguugcuaugacagagcagcuacagaugggcuuugggauaaccgugcaauauggaacugacaccaacagcguaugcccuaagcucgaguucgcgaaugauacaaaaaucgcaucgcagcuggguaacugugucgaauacucccuuuauggcgugucugggcguggaguuuuucagaauugcaccgccgugggcguccgccagcaaagauucguguacgacgcuuaucagaacuugguagguuacuauagcgaugacgggaacuacuacugucugagggccugcgugucaguuccagucagugugauuuaugauaaggagacuaagacacaugcaacgcucuuuggcuccguggccugugaacacaucucuagcaccaugucccaguacucacggagcacucgaaguaugcugaaacgcagagacucuacauauggaccgcuucagacccccgucggcugcguucugggguugguaaauuccagccucuucguggaggauuguaagcugccuuuaggacaaucgcugugcgcucuaccagacacacccucaacucucaccccuaggucugugcggagugucccaggugaaaugcgccuggccuccaucgcauuuaaccaccccauucagguggaucagcuuaauagcucuuacuucaaauugagcauaccgacgaacuuuuccuucggcguuacccaagaguauauccagacaacuauucagaaggugaccgucgacuguaaacaguacgugugcaauggguuccaaaagugcgaacagcugcucagagaguauggacaguuuuguucaaagaucaaccaggcgcugcauggcgcuaauuuaaggcaagaugacaguguucguaaccuguucgccagcgugaaaucuucccagucaaguccuauuaucccagguuuugggggcgacuucaaucuuacauugcucgagcccguaagcauauccacuggaucucggucggcacgaagcgccaucgaagaucugcuauuugacaaggucaccauugcugauccuggcuacaugcagggguacgacgauugcaugcagcaaggacccgccucagcaagagaccugaucugugcucaguauguggccggcuacaaagugcucccaccucugauggaugucaacauggaggcggccuauacguccagucuuuuggguucuauugcugggguuggauggacagcaggccugagcuccuucgccgcuauccccuuugcccagucaauauucuacagguuaaauggugugggcauuacccaacagguacucucugaaaaccagaagcugaucgcaaauaaauuuaaccaggcgcuuggggccaugcaaacuggauucacaaccacuaaugaggcuuuucgcaaggugcaggacgccgucaacaacaaugcacaggcucugagcaaguuggccagugaacucuccaacaccuucggcgcaauuagcgccucuaucggggauauaauccagcggcuggacgugcuagagcaagaugcucagauugacagacugaucaauggaaggcucacaacgcugaacgcguucguugcccagcagcuugugcgcucagaguccgcagcuuugagugcccaacuggccaaagauaaggucaaugaaugcgugaaagcucagagcaagcgaucgggcuuuuguggucaggggacccacauuguuucuuucguggucaacgcaccaaauggauuauauuuuaugcauguaggcuacuauccguccaaccacaucgaggugguuagcgccuacggucucugcgacgcggcuaauccuacuaacuguauagcccccgugaauggcuacuucauuaaaacaaacaauacccggaucgucgacgaauggucauauacagggaguucuuuuuacgcaccagagcccaucacuucccugaacaccaaguauguggccccucagguaacguaccaaaauauuagcacaaaccuuccacccccucugcuaggaaacucaaccggcaucgauuuccaggacgagcucgaugaauuuuucaagaaugugaguacuagcauuccgaacuuugggucccugacccagauaaauacaacuuugcuggacuuaaccuaugagaugcucucucugcaacaggucguuaaagcucuuaacgaaagcuacaucgaucugaaggaguugggaaauuauacauacuacaacaaauggccaugguauauuuggcucggcuucaucgcaggucugguggcccuagcgcugugcguguuuuucauucuuuguugcacgggguguggaaccaauugcaugggcaagcucaaaugcaaccguuguugcgacagauacgaagaguaugaucuggagccccauaagguccacgugcacuga

SEQ ID NO: 665 - RNA, 4062 nt, Artificial Sequence
  derived and/or modified CDS sequence (opt3) from MERS-CoV__ALJ54501__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacucucugggaggacggcgauuacuaccggaaacagcuguccccuuuagaaggugggggcuggcuggucgccucaggaaguacgguggcuaugacagagcagcuacagaugggcuuugggauaaccguucaauauggaacugacaccaacagcgugugcccaaagcucgaguucgcgaaugauacaaaaaucgcaucgcagcuggguaacuguguagaauacucccuuuauggcgucucugggcguggaguguuucagaauugcaccgccguuggcgugcgccagcaaagauucgucuacgacgcuuaucagaacuugguggguuacuauagcgaugacgggaacuacuacugucugagggccugcguaucagugccgguuagugucauuuaugauaaggagacuaagacacaugcaacgcucuuuggcuccguggccugugaacacaucucuagcaccaugucccaguacucacggagcacucgaaguaugcugaaacgcagagacucuacauauggaccccuucagaccccugugggcugcguccugggguugguuaauuccagccucuucguggaggauuguaagcugccauuaggacaaucgcugugcgcucuacccgacacaccuucaacucucaccccaaggucugugcggaguguacccggugaaaugcgccuggccuccaucgcauuuaaccacccgauucaggucgaucagcuuaauagcucuuacuucaaauugagcauaccuacgaacuuuuccuucggcgugacccaagaguauauccagacaacuauucagaagguuaccguggacuguaaacaguacgucugcaauggguuccaaaagugcgaacagcugcucagagaguauggacaguuuuguucaaagaucaaccaggcgcugcauggcgcuaauuuaaggcaagaugacagugugcguaaccuguucgccagcguuaaaucuucccagucaaguccaauuauccccgguuuugggggcgacuucaaucuuacauugcucgagccugugagcauauccacuggaucucggucggcacgaagcgccaucgaagaucugcuauuugacaagguaaccauugcugaucccggcuacaugcagggguacgacgauugcaugcagcaaggaccagccucagcaagagaccugaucugugcucaguaugucgccggcuacaaagugcucccuccccugauggaugugaacauggaggcggccuauacguccagucuuuuggguucuauugcuggggucggauggacagcaggccugagcuccuucgccgcuaucccauuugcccagucaauauucuacagguuaaaugguguuggcauuacccaacaggugcucucugaaaaccagaagcugaucgcaaauaaauuuaaccaggcgcuuggggccaugcaaacuggauucacaaccacuaaugaggcuuuucgcaagguacaggacgccgugaacaacaaugcacaggcucugagcaaguuggccagugaacucuccaacaccuucggcgcaauuagcgccucuaucggggauauaauccagcggcuggacguccuagagcaagaugcucagauugacagacugaucaauggaaggcucacaacgcugaacgcguucguggcccagcagcuuguucgcucagaguccgcagcuuugagugcccaacuggccaaagauaaggugaaugaaugcgucaaagcucagagcaagcgaucgggcuuuuguggucaggggacccacauugugucuuucguugugaacgcaccgaauggauuauauuuuaugcaugucggcuacuauccuuccaaccacaucgagguagugagcgccuacggucucugcgacgcggcuaaucccacuaacuguauagccccaguuaauggcuacuucauuaaaacaaacaauacccggaucguggacgaauggucauauacagggaguucuuuuuacgcacccgagccuaucacuucccugaacaccaaguaugucgccccacaggugacguaccaaaauauuagcacaaaccuucccccuccgcugcuaggaaacucaaccggcaucgauuuccaggacgagcucgaugaauuuuucaagaauguaaguacuagcauuccaaacuuugggucccugacccagauaaauacaacuuugcuggacuuaaccuaugagaugcucucucugcaacagguggucaaagcucuuaacgaaagcuacaucgaucugaaggaguugggaaauuauacauacuacaacaaauggcccugguauauuuggcucggcuucaucgcaggucugguugcccuagcgcugugcguguuuuucauucuuuguugcacgggguguggaaccaauugcaugggcaagcucaaaugcaaccguuguugcgacagauacgaagaguaugaucuggagccucauaaggugcacguccacuga

SEQ ID NO: 666 - RNA, 4062 nt, Artificial Sequence
  derived and/or modified CDS sequence (opt3) from MERS-CoV__ALJ54502__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaguucgcgaaugauacaaaaaucgcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaagacacaugcaacgcuguuuggcuccguggccugugaacacaucucuagcaccaugucccaguacucacggagcacucgaaguaugcucaaacgcagagacucuacauauggaccccugcagaccccugucggcugcguucuugggcugguaaauuccagcuuguucguggaggauuguaagcucccacugggacaaucguuaugcgcucugcccgacacaccuucaacucuaaccccaaggucugugcggaguguccccggugaaaugcgccucgccuccaucgcauuuaaccacccgauucagguggaucagcugaauagcucuuacuucaaacuuagcauaccuacgaacuuuuccuucggcguuacccaagaguauauccagacaacuauucagaaggugaccgucgacuguaaacaguacgugugcaauggguuccaaaagugcgaacaguugcugagagaguauggacaguuuuguucaaagaucaaccaggcgcuccauggcgcuaaucugaggcaagaugacaguguucguaacuuauucgccagcgugaaaucuucccagucaaguccaauuauccccgguuuugggggcgacuucaaucugacacuuuuggagccuguaagcauauccacuggaucucggucggcacgaagcgccaucgaagaucuccuguuugacaaggucaccauugcugaucccggcuacaugcagggguacgacgauugcaugcagcaaggaccagccucagugagagaccuaaucugugcacaguauguggcuggcuacaaaguccugccuccccucauggauguuaacauggaggccgcguauacguccagucugcuugguucuauugccggggugggauggacagcuggcuugagcuccuucgcagccaucccauuugcucagucaauauucuacaggcugaaugguguaggcauuacccaacagguguuaucugaaaaccagaagcucaucgccaauaaauuuaaccaggcacugggggcgaugcaaacuggauucacaaccacuaaugaggccuuucgcaagguccaggacgcugugaacaacaaugcccaggcacuuagcaagcuggcuagugaauuguccaacaccuucggcgccauuagcgcaucuaucggggauauaauccagcggcucgacguucuggagcaagaugcccagauugacagacuaaucaauggaaggcugacaacgcucaacgcuuucguggcgcagcagcugguccgcucagaguccgccgcacuuagugcucaauuggccaaagauaaggugaaugaaugcguuaaagcccagagcaagcgaucgggcuuuuguggucaggggacccacauugugucuuucgucguaaacgcuccgaauggacuguauuuuaugcaugugggcuacuauccuuccaaccacaucgagguugugagcgcauacgguuuaugcgacgccgcgaaucccacuaacuguauagcuccagucaauggcuacuucauuaaaacaaacaauacccggaucguggacgaauggucauauacagggaguucuuuuuacgcccccgagccuaucacuucccucaacaccaaguauguagcaccacaggugacguaccaaaauauuagcacaaaccugcccccuccgcuucugggaaacucaaccggcaucgauuuccaggacgagcuagaugaauuuuucaagaaugucaguacuagcauuccaaacuuugggucccucacccagauaaauacaacucuguuggaccugaccuaugagauguuaucucuccaacagguugugaaagcccugaacgaaagcuacaucgaucuuaaggagcugggaaauuauacauacuacaacaaauggcccugguauauuugguugggcuucaucgcuggucucguggcacuggcccuaugcgucuuuuucauucuguguugcacgggguguggaaccaauugcaugggcaaacuuaaguuuaaccguugcugugacagauacgaagaguaugaucucgagccucauaaggugcacguucacuga

SEQ ID NO: 667 - RNA, 4062 nt, Artificial Sequence
  derived and/or modified CDS sequence (opt3) from MERS-CoV__ALJ54512__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggcucaccucuuuucaagccgcuauguggacuuauacggaggcaauauguuccaguuugccacucugccggucuacgacacaauuaaauauuacaguaucaucccccacucuauuagauccauacagagcgauaggaaggcaugggcugccuucuauguguacaaacuucagccuuugaccuuucugcuagacuucucgguggauggcuauauccggcgcgcgauugacugcggguuuaacgaucucucucaacugcauuguuccuacgagucauucgacgucgaaaguggaguuuauagcguguccucuuuugaggccaagccaagcgguucaguaguggaacaggcagagggcgucgagugcgauuucaguccccuucuguccgggacgccuccacagguguacaacuuuaaacgauugguuuucaccaauuguaacuacaaucucacaaagcuguuaagccuguucucugugaacgacuuuacuugcucacaaaucagucccgcugccauagcuagcaauuguuauuccucucucauucuugauuacuucucguauccgcugagcaugaaguccgacuugucagucaguucugccggaccuaucagccaguuuaacuacaaacaguccuucucaaauccaaccugccuaauccuggcaacagugccccacaaccucacuaccauuacaaagccucugaaauauagcuacaucaauaagugcucuagacuucuguccgaugacaggaccgaaguaccccaguugguuaacgccaaucaauauaguccaugugugagcauuguccccucuacugugugggaggacggcgauuacuaccggaaacagcucuccccucuggaaggugggggcugguuagucgcuucaggaaguacgguggcgaugacagagcagcugcagaugggcuuugggauaaccguucaauauggaacugacaccaacagcgugugcccaaagcuagaguucgcaaaugauacaaaaaucgccucgcagcucgguaacuguguagaauacucccuguauggcgucucugggcguggaguguuucagaauugcaccgcuguuggcgugcgccagcaaagauucgucuacgacgccuaucagaaccuuguggguuacuauagcgaugacgggaacuacuacuguuugagggcaugcguaucagugccgguuagugucauuuaugauaaggagacuaagacacaugccacgcuguuuggcuccguggcuugugaacacaucucuagcaccaugucccaguacucacggagcacucgaaguaugcucaaacgcagagacucuacauauggaccccugcagaccccugugggcugcguccuugggcugguuaauuccagcuuguucguggaggauuguaagcucccacugggacaaucguuaugcgcccugcccgacacaccuucaacucuaaccccaaggucugugcggaguguacccggugaaaugcgccucgcauccaucgcguuuaaccacccgauucaggucgaucagcugaauagcucuuacuucaaacuuagcauaccuacgaacuuuuccuucggcgugacccaagaguauauccagacaacuauucagaagguuaccguggacuguaaacaguacgucugcaauggguuccaaaagugcgaacaguugcugagagaguauggacaguuuuguucaaagaucaaccaggcucuccauggcgccaaucugaggcaagaugacagugugcguaacuuauucgcaagcguuaaaucuucccagucaaguccaauuauccccgguuuugggggcgacuucaaucugacacuuuuggagccugugagcauauccacuggaucucggucggcccgaagcgcuaucgaagaucuccuguuugacaagguaaccauugccgaucccggcuacaugcagggguacgacgauugcaugcagcaaggaccagcaucagcuagagaccuaaucugugcccaguaugucgcgggcuacaaagugcugccuccccucauggaugugaacauggaggccgcuuauacguccagucugcuugguucuauugcaggggucggauggacagccggcuugagcuccuucgcugccaucccauuugcacagucaauauucuacaggcugaaugguguuggcauuacccaacagguguuaucugaaaaccagaagcucaucgcgaauaaauuuaaccaggcccugggggcuaugcaaacuggauucacaaccacuaaugaggccuuucgcaagguacaggacgcagugaacaacaaugcucaggcccuuagcaagcuggcaagugaauuguccaacaccuucggcgccauuagcgcuucuaucggggauauaauccagcggcucgacguccuggagcaagaugcgcagauugacagacuaaucaauggaaggcugacaacgcucaacgccuucguggcacagcagcugguucgcucagaguccgcugcccuuagugcccaauuggcuaaagauaaggugaaugaaugcgucaaagcacagagcaagcgaucgggcuuuuguggucaggggacccacauugugucuuucguugugaacgccccgaauggacuguauuuuaugcaugucggcuacuauccuuccaaccacaucgagguagugagcgcguacgguuuaugcgacgcugccaaucccacuaacuguauagcaccaguuaauggcuacuucauuaaaacaaacaauacccggaucguggacgaauggucauauacagggaguucuuuuuacgcccccgagccuaucacuucccucaacaccaaguaugucgcuccacaggugacguaccaaaauauuagcacaaaccugcccccuccgcuucugggaaacucaaccggcaucgauuuccaggacgagcuagaugaauuuuucaagaauguaaguacuagcauuccaaacuuugggucccucacccagauaaauacaacucuguuggaccugaccuaugagauguuaucucuccaacagguggucaaagcacugaacgaaagcuacaucgaucuuaaggagcugggaaauuauacauacuacaacaaauggcccugguauauuugguugggcuucaucgccggucucguugcgcuggcucuaugcguguuuuucauucuguguugcacgggguguggaaccaauugcaugggcaaacuuaagugcaaccguuguugcgacagauacgaagaguaugaucucgagccucauaaggugcacguccacuga

SEQ ID NO: 668 - RNA, 4062 nt, Artificial Sequence
  derived and/or modified CDS sequence (opt3) from MERS-CoV__ALJ54517__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcaacuacuaccggaaacagcucuccccucuggaaggugggggcugguuaguggccucaggaaguacgguugcuaugacagagcagcugcagaugggcuuugggauaaccgugcaauauggaacugauaccaauagcguaugcccaaagcuagaguucgcgaacgacacaaaaaucgcaucgcagcucgguaauugugucgaauacucccuguauggcgugucugggcguggaguuuuucagaacugcaccgccgugggcguccgccagcaaagauucguguacgaugcuuaucagaaccuuguagguuacuauagcgacgaugggaauuacuacuguuugagggccugcgugucaguuccggucagugugauuuaugacaaggagacuaagacacaugcaacgcuguuuggcuccguggccugugaacacaucucuagcaccaugucccaguacucacggagcacucgaaguaugcucaaacgcagagauucuacauauggaccccugcagaccccugucggcugcguucuugggcuggugaacuccagcuuguucguggaggacuguaagcucccacugggacaaucguuaugcgcucugcccgauacaccuucaacucuaaccccaaggucuguacggaguguccccggugaaaugcgccucgccuccaucgcauuuaaucacccgauucagguggaccagcugaacagcucuuacuucaaacuuagcauaccuacgaauuuuuccuucggcguuacccaagaguauauccagacaacuauucagaaggugaccgucgauuguaaacaguacgugugcaacggguuccaaaagugcgaacaguugcugagagaguauggacaguuuuguucaaagaucaaucaggcgcuccauggcgcuaaccugaggcaagacgauaguguucguaauuuauucgccagcgugaaaucuucccagucaaguccaauuauccccgguuuugggggcgacuucaaccugacacuuuuggagccuguaagcauauccacuggaucucggucggcacgaagcgccaucgaagaccuccuguuugauaaggucaccauugcugaccccggcuacaugcagggguacgaugacugcaugcagcaaggaccagccucagcaagagaucuaaucugugcucaguauguggccggcuacaaagugcugccuccccucauggacgucaauauggaggcggccuauacguccagucugcuugguucuauugcugggguuggauggacagcaggcuugagcuccuucgccgcuaucccauuugcccagucaauauucuacaggcugaacggugugggcauuacccaacagguauuaucugaaaaucagaagcucaucgcaaacaaauuuaaucaggcgcugggggccaugcaaacuggauucacaaccacuaacgaggcuuuucgcaaggugcaggaugccgucaacaauaacgcacaggcucuuagcaagcuggccagugaauuguccaauaccuucggcgcaauuagcgccucuaucggggacauaauccagcggcucgaugugcuggagcaagacgcucagauugauagacuaaucaacggaaggcugacaacgcucaaugcguucguugcccagcagcuggugcgcucagaguccgcagcucuuagugcccaauuggccaaagacaaggucaacgaaugcgugaaagcucagagcaagcgaucgggcuuuuguggucaggggacccacauuguuucuuucguggucaaugcaccgaacggacuguauuuuaugcauguaggcuacuauccuuccaaucacaucgaggugguuagcgccuacgguuuaugcgaugcggcuaaccccacuaauuguauagccccagugaacggcuacuucauuaaaacaaauaacacccggaucgucgacgaauggucauauacagggaguucuuuuuacgcacccgagccuaucacuucccucaauaccaaguauguggccccacagguaacguaccaaaacauuagcacaaaccugcccccuccgcuucugggaaauucaacccguaucgacuuccaggaugagcuagacgaauuuuucaagaacgugaguacuagcauuccaaauuuuggcucccucacccagauaaacacaacucuguuggaucugaccuaugagauguuaucucuccaacaggucguuaaagcucugaaugaaagcuacaucgaccuuaaggagcuggggaacuauacauacuacaauaaauggcccugguauauuugguugggauucaucgcaggccucguggcccuggcgcuaugcguguuuuucauucuguguugcacggguugugggaccaacugcaugggaaaacuuaagugcaauagauguugcgauagguacgaagaguaugaccucgagccucauaagguccacgugcacuga

SEQ ID NO: 669 - RNA, 4062 nt, Artificial Sequence
  derived and/or modified CDS sequence (opt3) from MERS-CoV__ALJ54518__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucccuccgaugacaggaccgaaguuccacagcuggugaacgcaaaucaauauagucccugugucagcauugugccuucuacugucugggaggacggcgauuacuaccggaaacaguuguccccacucgaaggugggggcuggcugguggccucaggaaguacgguugcuaugacagagcaguuacagaugggcuuugggauaaccgugcaauauggaacugacaccaacagcguaugcccgaagcuggaguucgcgaaugauacaaaaaucgcaucgcagcuagguaacugugucgaauacucccucuauggcgugucugggcguggaguuuuucagaauugcaccgccgugggcguccgccagcaaagauucguguacgacgcuuaucagaaccugguagguuacuauagcgaugacgggaacuacuacugucuuagggccugcgugucaguucccgucagugugauuuaugauaaggagacuaagacacaugcaacguuguuuggcuccguggccugugaacacaucucuagcaccaugucccaguacucacggagcacucgaaguaugcugaaacgcagagacucuacauauggaccucuccagaccccagucggcugcguucuggggcuuguaaauuccagccuguucguggaggauuguaaguugccccucggacaaucgcugugcgcuuuaccugacacaccaucaacucugacccccaggucugugcggagugucccgggugaaaugcgccuagccuccaucgcauuuaaccacccuauucagguggaucagcucaauagcucuuacuucaaacugagcauaccaacgaacuuuuccuucggcguuacccaagaguauauccagacaacuauucagaaggugaccgucgacuguaaacaguacgugugcaauggguuccaaaagugcgaacagcuuuugagagaguauggacaguuuuguucaaagaucaaccaggcgcugcauggcgcuaaucucaggcaagaugacaguguucguaaccuguucgccagcgugaaaucuucccagucaagucccauuaucccugguuuugggggcgacuucaauuuaacacugcuugagcccguaagcauauccacuggaucucggucggcacgaagcgccaucgaagauuugcucuuugacaaggucaccauugcugauccaggcuacaugcagggguacgacgauugcaugcagcaaggaccugccucagcaagagaccugaucugugcucaguauguggccggcuacaaagugcuacccccacugauggaugucaacauggaggcggccuauacguccagucuccuggguucuauugcugggguuggauggacagcaggccuuagcuccuucgccgcuaucccguuugcccagucaauauucuacagguugaauggugugggcauuacccaacagguacugucugaaaaccagaaguuaaucgcaaauaaauuuaaccaggcgcucggggccaugcaaacuggauucacaaccacuaaugaggcuuuucgcaaggugcaggacgccgucaacaacaaugcacaggcucugagcaaacuugccagugaacuguccaacaccuucggcgcaauuagcgccucuaucggggauauaauccagcgguuggacgugcucgagcaagaugcucagauugacagacugaucaauggaaggcuaacaacgcugaacgcguucguugcccagcagcucgugcgcucagaguccgcagcucugagugcccaacuugccaaggauaaggucaaugaaugcgugaaagcucagagcaagcgaucgggcuuuuguggucaggggacccacauuguuucuuucguggucaacgcaccuaauggauuguauuuuaugcauguaggcuacuaucccuccaaccacaucgaggugguuagcgccuacggucugugcgacgcggcuaauccaacuaacuguauagcccccgugaauggcuacuucauuaaaacaaacaauacccggaucgucgacgaauggucauauacagggaguucuuuuuacgcaccugagccaaucacuuccuuaaacaccaaguauguggcuccccagguaacguaccaaaauauuagcacaaaccucccuccgccacugcuuggaaacucaaccggcaucgauuuccaggacgagcuggaugaauuuuucaagaaugugaguacuagcauucccaacuuugggucccuaacccagauaaauacaacucuccuggacuugaccuaugagaugcugucuuuacaacaggucguuaaagcccucaacgaaagcuacaucgaucugaaggagcuuggaaauuauacauacuacaacaaauggccuugguauauuuggcugggcuucaucgcagguuugguggcccucgcgcugugcguguuuuucauucuauguugcacgggguguggaaccaauugcaugggcaagcugaaaugcaaccguuguugcgacagauacgaagaguaugaucuugagccacauaagguccacgugcacuga

SEQ ID NO: 670 - RNA, 4062 nt, Artificial Sequence
  derived and/or modified CDS sequence (opt3) from MERS-CoV__ALW82691__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuuagguccgaugaccggaccgaaguuccccagcuggugaacgcaaaucaauauaguccaugugucagcauugugcccucuacugucugggaggacggcgauuacuaccguaaacaguuguccccucucgaaggugggggcuggcugguggccucaggaaguacgguugcuaugacagagcaguuacagaugggcuuugggauaaccgugcaauauggaacugacaccaacagcguaugcccaaagcuggaguucgcgaaugauacaaaaaucgcaucgcagcuagguaacugugucgaauacucccucuauggcgugucugggcgcggaguuuuucagaauugcaccgccgugggcgucagacagcaaagguucguguacgacgcuuaucagaaccugguagguuacuauagcgaugacgggaacuacuacugucuucgggccugcgugucaguuccggucagugugauuuaugauaaggagacuaagacacaugcaacguuguuuggcuccguggccugugaacacaucucuagcaccaugucccaguacucacgaagcacucgcaguaugcugaaaagaagggacucuacauauggaccccuccagaccccugucggcugcguucuggggcuuguaaauuccagccuguucguggaggauuguaaguugccacucggacaaucgcugugcgcuuuacccgacacaccuucaacucugaccccacggucugugcgcaguguccccggugaaaugagacuagccuccaucgcauuuaaccacccgauucagguggaucagcucaauagcucuuacuucaaacugagcauaccuacgaacuuuuccuucggcguuacccaagaguauauccagacaacuauucagaaggugaccgucgacuguaaacaguacgugugcaauggguuccaaaagugcgaacagcuuuugagggaguauggacaguuuuguucaaagaucaaccaggcgcugcauggcgcuaaucuccgucaagaugacaguguucggaaccuguucgccagcgugaaaucuucccagucaaguccaauuauccccgguuuugggggcgacuucaauuuaacacugcuugagccuguaagcauauccacuggaucucgaucggcaagaagcgccaucgaagauuugcucuuugacaaggucaccauugcugaucccggcuacaugcagggguacgacgauugcaugcagcaaggaccagccucagcaagggaccugaucugugcucaguauguggccggcuacaaagugcuaccuccccugauggaugucaacauggaggcggccuauacguccagucuccuggguucuauugcugggguuggauggacagcaggccuuagcuccuucgccgcuaucccauuugcccagucaauauucuaccgcuugaauggugugggcauuacccaacagguacugucugaaaaccagaaguuaaucgcaaauaaauuuaaccaggcgcucggggccaugcaaacuggauucacaaccacuaaugaggcuuuucggaaggugcaggacgccgucaacaacaaugcacaggcucugagcaagcucgccagugaacuguccaacaccuucggcgcaauuagcgccucuaucggggauauaauccagagauuggacgugcucgagcaagaugcucagauugacaggcugaucaauggacgccuaacaacgcugaacgcguucguugcccagcagcucgugcgaucagaguccgcagcucugagugcccaacuugccaaagauaaggucaaugaaugcgugaaagcucagagcaagcggucgggcuuuuguggucaggggacccacauuguuucuuucguggucaacgcaccgaauggauuguauuuuaugcauguaggcuacuauccuuccaaccacaucgaggugguuagcgccuacggucugugcgacgcggcuaaucccacuaacuguauagccccagugaauggcuacuucauuaaaacaaacaauacccguaucgucgacgaauggucauauacagggaguucuuuuuacgcacccgagccuaucacuuccuuaaacaccaaguauguggccccacagguaacguaccaaaauauuagcacaaaccuucccccuccgcugcuuggaaacucaaccggcaucgauuuccaggacgagcuggaugaauuuuucaagaaugugaguacuagcauuccaaacuuugggucccuaacccagauaaauacaacucuccuggacuugaccuaugagaugcugucuuuacaacaggucguuaaagcucucaacgaaagcuacaucgaucugaaggagcuuggaaauuauacauacuacaacaaauggcccugguauauuuggcugggcuucaucgcagguuugguggcccucgcgcugugcguguuuuucauucuauguugcacgggguguggaaccaauugcaugggcaagcugaaaugcaacagauguugcgacagguacgaagaguaugaucuugagccucauaagguccacgugcacuga

SEQ ID NO: 671 - RNA, 4062 nt, Artificial Sequence
  derived and/or modified CDS sequence (opt3) from MERS-CoV__ALW82742__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccagaaaauuuacccugcauucaugcugggcuccucuguaggcaacuuuagcgaugggaagaugggacgcuucuuuaaucauacucuaguucuccugccagacgguuguggcacccuucugcgagccuucuacugcaucuuggagccccguuccgggaaccacuguccugcuggaaauucauauacaaguuuugccacuuaccauaccccagcgacagauugcagcgacggcaacuauaauagaaacgcaucucucaauuccuucaaggaauacuucaaccugaggaauuguaccuuuauguauacguacaacauaacugaggaugaaauucuggagugguucgguaucacacaaaccgcccagggggugcaccucuuuucaagccgguaugucgacuuauacggaggcaauauguuccaguuugcuacucugccgguguacgacacaauuaaauauuacaguaucaucccccacucuauucgcuccauacagagcgauagaaaggccugggcagcuuucuauguguacaaacuucaaccuuugaccuuucugcuagacuucucggucgauggcuauaucaggcgggccauugacugcggguuuaacgaucucucucagcugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacaaguuuacaacuuuaaacgcuugguguucaccaauuguaacuacaaucucacaaagcuguuaagccuguucucugucaacgacuuuacuugcucacagaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucucgacuucuguccgaugacagaaccgaaguuccccaauuggugaacgcaaaucaguauaguccaugugucagcauugugcccucuacugucugggaggacggcgauuacuacaggaaacagcucuccccucuggaaggugggggcugguuaguggccucaggaaguacgguugcuaugacagagcagcugcaaaugggcuuugggauaaccgugcaguauggaacugacaccaacagcguaugcccaaagcuagaguucgcgaaugauacaaaaaucgcaucgcagcucgguaacugugucgaauacucccuguauggcgugucugggcggggaguuuuucagaauugcaccgccgugggcguccgucaacagcgcuucguguacgacgcuuaucagaaccuuguagguuacuauagcgaugacgggaacuacuacuguuugagagccugcgugucaguuccggucagugugauuuaugauaaggagacuaagacacaugcaacgcuguuuggcuccguggccugugaacacaucucuagcaccaugucccaguacucaaggagcacucggaguaugcucaaacgacgcgacucuacauauggaccccugcaaaccccugucggcugcguucuugggcugguaaauuccagcuuguucguggaggauuguaagcucccacugggacagucguuaugcgcucugcccgacacaccuucaacucuaaccccaagaucugugaggaguguccccggugaaaugcggcucgccuccaucgcauuuaaccacccgauucagguggaucaacugaauagcucuuacuucaaacuuagcauaccuacgaacuuuuccuucggcguuacccaggaguauauccagacaacuauucagaaggugaccgucgacuguaaacaauacgugugcaauggguuccagaagugcgaacaguugcugcgcgaguauggacaguuuuguucaaagaucaaccaagcgcuccauggcgcuaaucugagacaggaugacaguguuaggaacuuauucgccagcgugaaaucuucccagucaaguccaauuauccccgguuuugggggcgacuucaaucugacacuuuuggagccuguaagcauauccacuggaucucguucggcacggagcgccaucgaagaucuccuguuugacaaggucaccauugcugaucccggcuacaugcagggguacgacgauugcaugcaacagggaccagccucagcacgagaccuaaucugugcucaguauguggccggcuacaaagugcugccuccccucauggaugucaacauggaggcggccuauacguccagucugcuugguucuauugcugggguuggauggacagcaggcuugagcuccuucgccgcuaucccauuugcccaaucaauauucuacagacugaauggugugggcauuacccagcagguauuaucugaaaaccagaagcucaucgcaaauaaauuuaaccaagcgcugggggccaugcagacuggauucacaaccacuaaugaggcuuuuaggaaggugcaggacgccgucaacaacaaugcacaggcucuuagcaagcuggccagugaauuguccaacaccuucggcgcaauuagcgccucuaucggggauauaauccaacgccucgacgugcuggagcaggaugcucagauugaccggcuaaucaauggaagacugacaacgcucaacgcguucguugcccagcaacuggugaggucagaguccgcagcucuuagugcccaguuggccaaagauaaggucaaugaaugcgugaaagcucagagcaagcgcucgggcuuuuguggucaggggacccacauuguuucuuucguggucaacgcaccgaauggacuguauuuuaugcauguaggcuacuauccuuccaaccacaucgaggugguuagcgccuacgguuuaugcgacgcggcuaaucccacuaacuguauagccccagugaauggcuacuucauuaaaacaaacaauacccgaaucgucgacgaauggucauauacagggaguucuuuuuacgcacccgagccuaucacuucccucaacaccaaguauguggccccacaaguaacguaccagaauauuagcacaaaccugcccccuccgcuucugggaaacucaaccggcaucgauuuccaggacgagcuagaugaauuuuucaagaaugugaguacuagcauuccaaacuuugggucccucacccaaauaaauacaacucuguuggaccugaccuaugagauguuaucucuccagcaggucguuaaagcucugaacgaaagcuacaucgaucuuaaggagcugggaaauuauacauacuacaacaaauggcccugguauauuugguugggcuucaucgcaggucucguggcccuggcgcuaugcguguuuuucauucuguguugcacgggguguggaaccaauugcaugggcaaacuuaagugcaaccgguguugcgaccguuacgaagaguaugaucucgagccucauaagguccacgugcacuga

SEQ ID NO: 672 - RNA, 4062 nt, Artificial Sequence
  derived and/or modified CDS sequence (opt3) from MERS-CoV__ALW82753__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccaagcacagauugcucugacggcaacuauaauaggaacgcgucccucaauucauucaaggaauacuucaaccugcggaauuguaccuuuauguauacguacaacauaacugaggaugaaauucuggagugguucgguaucacacagaccgcacaaggggugcaccucuuuagcagucgcuaugucgacuuauacggaggcaauauguuccaguuugccacucugccgguguacgacacaauuaaauauuacucuaucaucccccacuccauuagaagcauacagucggauaggaaggcuugggccgcauucuauguguacaaacuucagccuuugaccuuucugcuagacuucucugucgauggcuauauccggcgcgcuauugacugcggguuuaacgaucucucccaacugcauuguucauacgagaguuucgacguugaaagcggaguguauuccguaucuagcuuugaggccaagccaucagguaguguggucgaacaggcggagggcguggagugcgauuucagcccccuucuguccgggacgccuccacagguuuacaacuuuaaacgauugguguucaccaauuguaacuacaaucucacaaagcuguuaucucuguucucagucaacgacuuuacuugcagucaaaucagccccgccgcaauagcuuccaauuguuauucuucgcucauucuugauuacuucagcuauccgcuguccaugaagucagacuugagugugucuagcgccggaccuaucucccaguuuaacuacaaacagucauucagcaauccaaccugccuaauccuggcuacaguaccccacaaccucacuaccauuacaaagccucugaaauauucuuacaucaauaagugcuccagacuucugagugaugacaggaccgaaguuccccaguuggugaacgccaaucaauauagcccaugugucucuauugugcccuccacugucugggaggacggcgauuacuaccggaaacagcucucaccucuggaaggugggggcugguuaguggcaaguggaagcacgguugccaugacagagcagcugcagaugggcuuugggauaaccgugcaauauggaacugacaccaacucgguaugcccaaagcuagaguucgcuaaugauacaaaaaucgcgucccagcucgguaacugugucgaauacucucuguauggcgugagcgggcguggaguuuuucagaauugcaccgcagugggcguccgccagcaaagauucguguacgacgccuaucagaaccuuguagguuacuauucagaugacgggaacuacuacuguuugagggcuugcgugaguguuccggucuccgugauuuaugauaaggagacuaagacacaugccacgcuguuuggcucuguggcaugugaacacaucagcuccaccaugucacaguacagccggaguacucgaucuaugcucaaacgcagagacuccacauauggaccccugcagaccccugucggcugcguucuugggcuggugaauagcucguuguucguggaggauuguaagcucccacugggacaaucauuaugcgcccugcccgacacaccuucuacucuaaccccaaggaguguacgguccguccccggugaaaugcgccucgcuagcaucgccuuuaaccacccgauucaggugggccagcuuaauucuagcuacuucaaacuuuccauaccuacgaacuuuucauucgggguuacccaagaguauauccagacaacuauucagaaggugaccgucgauuguaaacaguacgugugcaauggauuccaaaagugcgaacaguugcugagagaguauggccaguuuuguaguaagaucaaccaggcacuccauggugcgaaucugaggcaagacgauagcguucguaacuuauucgcuucugugaaauccucacagaguagcccaauuauccccggguuuggcggagacuucaaucugacacuuuuggagccuguauccauaucuacuggcucgcggagcgcccgaucagcaaucgaagaccuccuguuugauaaggucaccauugccgaccccggguacaugcagggauacgaugacugcaugcagcaaggcccagcuuccgccagagaucuaaucugugcacaguauguggcugguuacaaagugcugccuccccucauggacgucaacauggaggccgcguauacgaguucucugcuugggagcauugccggaguuggcuggacagcugguuuguccucauucgcagccaucccauuugcucagucuauauucuacaggcugaauggcguggggauuacccaacagguauuaagcgaaaaccagaagcucaucgccaauaaauuuaaccaggcacugggagcgaugcaaacuggcuucacaaccacuaaugaggccuuucgcaaggugcaggaugcugucaacaacaaugcccaggcacuuaguaagcuggcuuccgaauugagcaacaccuucggggccauuucugcaucaaucggagacauaauccagcggcucgaugugcuggagcaagacgcccagauugauagacuaaucaauggcaggcugacaacgcucaacgcuuucguugcgcagcagcuggugcgcuccgagagugccgcacuuagcgcucaauuggccaaagacaaggucaaugaaugcgugaaagcccagucgaagcgaucugguuuuugugggcagggaacccacauuguuuccuucguggucaacgcuccgaauggccuguauuuuaugcauguagguuacuauccuagcaaccacaucgaggugguuucagcauacggcuuaugcgaugccgcgaaucccacuaacuguauagcuccagugaauggguacuucauuaaaacaaacaauacccggaucgucgacgaauggaguuauacaggaucuuccuuuuacgcccccgagccuaucacuagccucaacaccaaguauguggcaccacagguaacguaccaaaauauuucaacaaaccugcccccuccgcuucugaguaacagcaccggcaucgacuuccaggaugagcuagacgaauuuuucaagaauguguccacuucuauuccaaacuuugggagccucacccagauaaauacaacucuguuggaucugaccuaugagauguuaucccuccaacaggucguuaaagcccugaacgaaucauacaucgaccuuaaggagcugggaaauuauacauacuacaacaaauggcccugguauauuugguugggcuucaucgcuggucucguggcacuggcccuaugcguguuuuucauucuguguugcacgggguguggaaccaauugcaugggcaagcugaaaugcaaccguuguugcgauagauacgaagaguaugaccucgagccucauaagguccacgugcacuga

SEQ ID NO: 673 - RNA, 4062 nt, Artificial Sequence
  derived and/or modified CDS sequence (opt3) from MERS-CoV__ALX27228__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucuggaaagacggcgauuacuaccggaagcagcucuccccucuggagggugggggcugguuaguggccucaggaaguacgguugcuaugacagaacagcugcagaugggcuuugggauaaccgugcaauauggaacugacaccaacagcguaugcccaaaacuagaguucgcgaaugauacaaagaucgcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaaaacacaugcaacgcuguuuggcuccguggccugugagcacaucucuagcaccaugucccaguacucacggagcacucgaaguaugcucaagcgcagagacucuacauauggaccccugcagaccccugucuccugcguucuuggccuggugaauagcucguuguucguggaagauuguaaacucccacuggggcaaucauuaugcgcucugcccgacacaccuucuacucuaaccccaaggaguguacgguccguccccggagagaugcgccucgccagcaucgcauuuaaccacccgauucagguggaucagcuuaauucuagcuacuucaagcuguccauaccuacgaacuuuucauucgguguuacccaagaauauauccagacaacuauucagaaagugaccgucgacuguaagcaguacgugugcaauggcuuccaaaagugcgagcaguugcugagagaauaugggcaguuuuguaguaaaaucaaccaggcgcuccauggagcuaaucugaggcaagaugacagcguucguaacuuauucgccucugugaaguccucacagaguagcccaauuauccccggcuuugguggggacuucaaucugacacuuuuggagccuguauccauaucuacuggcucgcggagcgcacgaucagccaucgaggaucuccuguuugacaaagucaccauugcugaucccggauacaugcagggcuacgacgauugcaugcagcaagggccagccuccgcaagagaccuaaucugugcucaguauguggccggauacaaggugcugccuccccucauggaugucaacauggaagcggccuauacgaguucucugcuuggcagcauugcugguguuggguggacagcaggauuguccucauucgccgcuaucccauuugcccagucuauauucuacaggcugaauggcguggguauuacccaacagguauuaagcgagaaccagaaacucaucgcaaauaaguuuaaccaggcgcugggcgccaugcaaacuggguucacaaccacuaaugaggcuuuucgcaaggugcaggacgccgucaacaacaaugcacaggcucuuaguaaacuggccuccgaauugagcaacaccuucggagcaauuucugccucaaucggcgauauaauccagcggcucgacgugcuggaacaagaugcucagauugacagacuaaucaaugggaggcugacaacgcucaacgcguucguugcccagcagcuggugcgcuccgagagugcagcucuuagcgcccaauuggccaaggauaaagucaaugagugcgugaaggcucagucgaaacgaucuggauuuuguggccaggguacccacauuguuuccuucguggucaacgcaccgaaugggcuguauuuuaugcauguaggauacuauccuagcaaccacaucgaagugguuucagccuacggcuuaugcgacgcggcuaaucccacuaacuguauagccccagugaaugguuacuucauuaagacaaacaauacccggaucgucgacgaguggaguuauacagggucuuccuuuuacgcacccgaaccuaucacuagccucaacaccaaguauguggccccacagguaacguaccaaaauauuucaacaaaccugcccccuccgcuucugggcaacaguaccggaaucgauuuccaggacgagcuagaugaguuuuucaaaaaugugagcacuuccauuccaaacuuuggcucucucacccagauaaauacaacucuguuggaccugaccuaugaaauguuaagccuccaacaggucguuaaggcucugaacgaguccuacaucgaucuuaaagaacuggggaauuauacauacuacaacaaguggcccugguauauuugguugggauucaucgcaggccucguggcccuggcgcuaugcguguuuuucauucuguguugcacggguugugggaccaauugcaugggaaaacuuaagugcaaccguuguugcgacagauacgaggaauaugaucucgagccucauaaaguccacgugcacuga

SEQ ID NO: 674 - RNA, 4062 nt, Artificial Sequence
  derived and/or modified CDS sequence (opt3) from MERS-CoV__ALX27232__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcuacgggaagaugggacgauucuuuaaucauacucuaguucuccugccagaugguuguggcacccuucugcgugccuucuauugcaucuuggagcccagauccgggaaccacuguccugcuggaaauucauacacaaguuuugccacuuaucauaccccagcgacagacugcagcgauggcaacuacaauaggaacgcaucucucaauuccuucaaggaauauuucaaccugcggaauuguaccuuuauguacacguauaacauaacugaggacgaaauucuggagugguucgguaucacacagaccgcccaaggggugcaccucuuuucaagccgcuacgucgauuuauacggaggcaauauguuccaguuugcuacucugccgguguaugacacaauuaaauacuauaguaucaucccccacucuauuagauccauacagagcgacaggaaggccugggcagcuuucuacguguauaaacuucagccuuugaccuuucugcuagauuucucggucgacggcuacauccggcgcgccauugauugcggguuuaacgaccucucucaacugcauuguuccuaugagucauucgauguugaaaguggaguguacagcguauccucuuuugaggcgaagccaagcgguucaguggucgaacaggccgagggcguggagugcgacuucaguccccuucuguccgggacgccuccacagguuuacaacuuuaaacgauugguguucaccaauuguaacuauaaucucacaaagcuguuaagccuguucucugucaacgauuuuacuugcucacaaaucagucccgcagcuauagccagcaauuguuacuccucucucauucuugacuauuucucguacccgcugagcaugaaguccgauuugucagugaguucugcuggaccuaucagccaguuuaacuauaaacaguccuucucaaauccaaccugccuaauccuggccacaguaccccacaaccucacuaccauuacaaagccucugaaauacagcuauaucaauaagugcucuagacuucuguccgacgauaggaccgaaguuccccaguuggugaacgcaaaucaauacaguccaugugucagcauugugcccucuacugucugggaggacggcgacuacuaucggaaacagcucuccccucuggaaggugggggcugguuaguggccucaggaaguacgguugcuaugacagagcagcugcagaugggcuuugggauaaccgugcaauacggaacugauaccaacagcguaugcccaaagcuagaguucgcgaaugacacaaaaaucgcaucgcagcucgguaacugugucgaauauucccuguacggcgugucugggcguggaguuuuucagaauugcaccgccgugggcguccgccagcaaagauucguguaugaugcuuaccagaaccuuguagguuauuacagcgacgaugggaacuacuauuguuugagggccugcgugucaguuccggucagugugauuuacgacaaggagacuaagacacaugcaacgcuguuuggcuccguggccugugaacacaucucuagcaccaugucccaguauucacggagcacucgaaguaugcucaaacgcagagauucuacauacggaccccugcagaccccugucggcugcguucuugggcugguaaauuccagcuuguucguggaggacuguaagcucccacugggacaaucguuaugcgcucugcccgauacaccuucaacucuaaccccaaggucugugcggaguguccccggugaaaugcgccucgccuccaucgcauuuaaccacccgauucagguggaccagcugaauagcucuuauuucaaacuuagcauaccuacgaacuuuuccuucggcguuacccaagaguacauccagacaacuauucagaaggugaccgucgauuguaaacaguaugugugcaauggguuccaaaagugcgaacaguugcugagagaguacggacaguuuuguucaaagaucaaccaggcgcuccauggcgcuaaucugaggcaagacgauaguguucguaacuuauucgccagcgugaaaucuucccagucaaguccaauuauccccgguuuugggggcgacuucaaucugacacuuuuggagccuguaagcauauccacuggaucucggucggcacgaagcgccaucgaagaccuccuguuugauaaggucaccauugcugaccccggcuacaugcagggguaugaugacugcaugcagcaaggaccagccucagcaagagaucuaaucugugcucaguacguggccggcuauaaagugcugccuccccucauggacgucaacauggaggcggccuacacguccagucugcuugguucuauugcugggguuggauggacagcaggcuugagcuccuucgccgcuaucccauuugcccagucaauauucuauaggcugaauggugugggcauuacccaacagguauuaucugaaaaccagaagcucaucgcaaauaaauuuaaccaggcgcugggggccaugcaaacuggauucacaaccacuaaugaggcuuuucgcaaggugcaggaugccgucaacaacaaugcacaggcucuuagcaagcuggccagugaauuguccaacaccuucggcgcaauuagcgccucuaucggggacauaauccagcggcucgaugugcuggagcaagacgcucagauugauagacuaaucaauggaaggcugacaacgcucaacgcguucguugcccagcagcuggugcgcucagaguccgcagcucuuagugcccaauuggccaaagacaaggucaaugaaugcgugaaagcucagagcaagcgaucgggcuuuuguggucaggggacccacauuguuucuuucguggucaacgcaccgaauggacuguacuuuaugcauguaggcuauuacccuuccaaccacaucgaugugguuagcgccuacgguuuaugcgacgcggcuaaucccacuaacuguauagccccagugaauggcuauuucauuaaaacaaacaauacccggaucgucgacgaguggucauacacagggaguucuuuuuaugcacccgaaccuaucacuucccucaacaccaaguacguggccccacagguaacguaucaaaauauuagcacaaaccugcccccuccgcuucugggaaacucaaccggcaucgauuuccaggacgagcuagaugaguuuuucaagaaugugaguacuagcauuccaaacuuugggucccucacccagauaaauacaacucuguuggaccugaccuacgaaauguuaucucuccaacaggucguuaaagcucugaacgagagcuauaucgaucuuaaggaacugggaaauuacacauacuauaacaaauggcccugguacauuugguugggcuucaucgcaggucucguggcccuggcgcuaugcguguuuuucauucuguguugcacgggguguggaaccaauugcaugggcaaacuuaagugcaaccguuguugcgacagauaugaggaauacgaucucgagccucauaagguccacgugcacuga

SEQ ID NO: 675 - RNA, 4062 nt, Artificial Sequence
  derived and/or modified CDS sequence (opt3) from MERS-CoV__AMQ48993__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguauaguugcuaugacggagcagcugcagaugggcuuugggaucacagugcaauauggaaccgacacuaacagcguaugcccaaagcuagaguucgcgaaugauaccaaaauugcaucgcagcucgguaacugugucgaauacucccuguauggcgugucugggcguggaguuuuucagaauugcacagccgugggcguccgccagcaaagauucguguacgacgcuuaucagaaccuuguagguuacuauagcgaugacgggaacuacuacuguuugagggccugcgugucaguuccggucagugugaucuaugauaaggagaccaagacucaugcaacacuguuuggcuccguggccugugaacacaucucuagcacgaugucccaguacucacggagcacccgaaguaugcucaaacgcagagacucuacuuauggaccccugcagacaccugucggcugcguucuugggcugguaaauuccagcuuguucguggaggauuguaagcucccacugggacaaucguuaugcgcucugcccgacaccccuucaacacuaacuccaaggucugugcggaguguccccggugaaaugcgccucgccuccauugcauuuaaccacccgauacagguggaucagcugaauagcucuuacuucaaacuuagcaucccuaccaacuuuuccuucggcguuacgcaagaguauauucagaccacaauccagaaggugacugucgacuguaaacaguacgugugcaauggguuccaaaagugcgaacaguugcugagagaguauggacaguuuuguucaaagauuaaccaggcgcuccauggcgcuaaucugaggcaagaugacaguguucguaacuuauucgccagcgugaaaucuucccagucaaguccaaucauacccgguuuugggggcgacuucaaucugacccuuuuggagccuguaagcaucuccacaggaucucggucggcacgaagcgccauugaagaucuccuguuugacaaggucacuaucgcugaucccggcuacaugcagggguacgacgauugcaugcagcaaggaccagccucagcaagagaccuaauuugugcucaguauguggccggcuacaaagugcugccuccccucauggaugucaacauggaggcggccuauaccuccagucugcuugguucuaucgcugggguuggauggacggcaggcuugagcuccuucgccgcuauaccauuugcccagucaauuuucuacaggcugaauggugugggcaucacacaacagguauuaucugaaaaccagaagcucauugcaaauaaauuuaaccaggcgcugggggccaugcaaaccggauucacuacaaccaaugaggcuuuucgcaaggugcaggacgccgucaacaacaaugcacaggcucuuagcaagcuggccagugaauuguccaacacuuucggcgcaaucagcgccucuauaggggauaucauucagcggcucgacgugcuggagcaagaugcucagaucgacagacuaauuaauggaaggcugaccacacucaacgcguucguugcccagcagcuggugcgcucagaguccgcagcucuuagugcccaauuggccaaagauaaggucaaugaaugcgugaaagcucagagcaagcgaucgggcuuuuguggucaggggacgcacaucguuucuuucguggucaacgcaccgaauggacuguauuuuaugcauguaggcuacuauccuuccaaccacauagaggugguuagcgccuacgguuuaugcgacgcggcuaaucccaccaacuguauuacuccagugaauggcuacuucaucaaaacaaacaauacccggaucgucgacgaauggucauauacagggaguucuuuuuacgcccccgagccuauuacuucccucaacaccaaguauguggcaccacagguaacguaccaaaauaucagcacaaaccugcccccuccgcuucugucaaacaguaccggaauugauuuccaggacgagcuagaugaauuuuucaagaaugugagcacuuccauaccaaacuuuggcucucucacccagaucaauacaacucuguuggaccugaccuaugagauguuaagccuccaacaggucguuaaagcccugaacgaauccuacauugaucuuaaggagcuggggaauuauacauacuacaacaaauggcccugguauaucugguugggauucauugcuggccucguggcacuggcccuaugcguguuuuucauccuguguugcacggguugugggaccaauugcaugggaaaacuuaagugcaaccguuguugcgacagauacgaagaguaugaucucgagccucauaagguccacgugcacuga

SEQ ID NO: 676 - RNA, 4062 nt, Artificial Sequence
  derived and/or modified CDS sequence (opt3) from MERS-CoV__AMW90844__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccuuccaauauggaacugacaccaacagcgugugcccaaagcuagaauuugcgaaugauacaaaaaucgcaucgcagcucgguaacuguguagaguacucccuguauggcgucucugggcguggaguguuccagaauugcaccgccguuggcgugcgccagcaaagauuugucuacgacgcuuaucagaaccuuguggguuacuauagcgaugacgggaacuacuacuguuugagggccugcguaucagugccgguuagugucauuuaugauaaggagacuaagacacaugcaacgcuguucggcuccguggccugugaacacaucucuagcaccaugucccaguacucacggagcacucgaaguaugcucaaacgcagagacucuacauauggaccccugcagaccccugugggcugcguccuugggcugguuaauuccagcuuguuuguggaggauuguaagcucccacugggacaaucguuaugcgcucugcccgacacaccuucaacucuaaccccaaggucugugcggaguguacccggugaaaugcgccucgccuccaucgcauucaaccacccgauucaggucgaucagcugaauagcucuuacuuuaaacuuagcauaccuacgaacuucuccuucggcgugacccaagaguauauccagacaacuauucagaagguuaccguggacuguaaacaguacgucugcaauggguuucaaaagugcgaacaguugcugagagaguauggacaguucuguucaaagaucaaccaggcgcuccauggcgcuaaucugaggcaagaugacagugugcguaacuuauuugccagcguuaaaucuucccagucaaguccaauuauccccgguuucgggggcgacuuuaaucugacacuuuuggagccugugagcauauccacuggaucucggucggcacgaagcgccaucgaagaucuccuguucgacaagguaaccauugcugaucccggcuacaugcagggguacgacgauugcaugcagcaaggaccagccucagcaagagaccuaaucugugcucaguaugucgccggcuacaaagugcugccuccccucauggaugugaacauggaggcggccuauacguccagucugcuugguucuauugcuggggucggauggacagcaggcuugagcuccuuugccgcuaucccauucgcccagucaauauuuuacaggcugaaugguguuggcauuacccaacagguguuaucugaaaaccagaagcucaucgcaaauaaauucaaccaggcgcugggggccaugcaaacuggauuuacaaccacuaaugaggcuuuccgcaagguacaggacgccgugaacaacaaugcacaggcucuuagcaagcuggccagugaauuguccaacaccuucggcgcaauuagcgccucuaucggggauauaauccagcggcucgacguccuggagcaagaugcucagauugacagacuaaucaauggaaggcugacaacgcucaacgcguuuguggcccagcagcugguucgcucagaguccgcagcucuuagugcccaauuggccaaagauaaggugaaugaaugcgucaaagcucagagcaagcgaucgggcuucuguggucaggggacccacauugugucuuuuguugugaacgcaccgaauggacuguauuucaugcaugucggcuacuauccuuccaaccacaucgagguagugagcgccuacgguuuaugcgacgcggcuaaucccacuaacuguauagccccaguuaauggcuacuuuauuaaaacaaacaauacccggaucguggacgaauggucauauacagggaguucuuucuacgcacccgagccuaucacuucccucaacaccaaguaugucgccccacaggugacguaccaaaauauuagcacaaaccugcccccuccgcuucugggaaacucaaccggcaucgauuuucaggacgagcuagaugaguucuuuaagaauguaaguacuagcauuccaaacuucgggucccucacccagauaaauacaacucuguuggaccugaccuaugaaauguuaucucuccaacagguggucaaagcucugaacgaaagcuacaucgaucuuaaggagcugggaaauuauacauacuacaacaaauggcccugguauauuugguugggcuuuaucgcaggucucguugcccuggcgcuaugcguguucuuuauucuguguugcacgggguguggaaccaauugcaugggcaaacuuaagugcaaccguuguugcgacagauacgaagaguaugaucucgagccucauaaggugcacguccacuga

SEQ ID NO: 677 - RNA, 4062 nt, Artificial Sequence
  derived and/or modified CDS sequence (opt3) from MERS-CoV__AMW90852__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaauuucacaaagcuccugagcuuauuuucugucaacgacuucacuugcucacaaaucagucccgcagcuauagccagcaauuguuauuccucucugauucucgauuacuuuucguauccgcuuagcaugaaguccgaccugucagugaguucugcuggaccuaucagccaguucaacuacaaacaguccuuuucaaauccaaccugcuugauccuagccacaguaccccacaaccugacuaccauuacaaagccucucaaauauagcuacaucaauaagugcucuagacugcuuuccgaugacaggaccgaaguuccccagcuggugaacgcaaaucaauauaguccaugugucagcauugugcccucuacugucugggaggacggcgauuacuaccggaaacaguuguccccucucgaaggugggggcuggcugguggccucaggaaguacgguugcuaugacagagcaguuacagaugggcuucgggauaaccgugcaauauggaacugacaccaacagcguaugcccaaagcuggaauuugcgaaugauacaaaaaucgcaucgcagcuagguaacugugucgaguacucccucuauggcgugucugggcguggaguuuuccagaauugcaccgccgugggcguccgccagcaaagauuuguguacgacgcuuaucagaaccugguagguuacuauagcgaugacgggaacuacuacugucuuagggccugcgugucaguuccggucagugugauuuaugauaaggagacuaagacacaugcaacguuguucggcuccguggccugugaacacaucucuagcaccaugucccaguacucacggagcacucgaaguaugcugaaacgcagagacucuacauauggaccccuccagaccccugucggcugcguucuggggcuuguaaauuccagccuguuuguggaggauuguaaguugccacucggacaaucgcugugcgcuuuacccgacacaccuucaacucugaccccaaggucugugcggaguguccccggugaaaugcgccuagccuccaucgcauucaaccacccgauucagguggaucagcucaauagcucuuacuuuaaacugagcauaccuacgaacuucuccuucggcguuacccaagaguauauccagacaacuauucagaaggugaccgucgacuguaaacaguacgugugcaauggguuucaaaagugcgaacagcuuuugagagaguauggacaguucuguucaaagaucaaccaggcgcugcauggcgcuaaucucaggcaagaugacaguguucguaaccuguuugccagcgugaaaucuucccagucaaguccaauuauccccgguuucgggggcgacuuuaauuuaacacugcuugagccuguaagcauauccacuggaucucggucggcacgaagcgccaucgaagaucuccucuucgacaaggucaccauugcugaucccggcuacaugcagggguacgacgauugcaugcagcaaggaccagccucagcaagagaccugaucugugcucaguauguggccggcuacaaagugcuaccuccccugauggaugucaacauggaggcggccuauacguccagucuccuggguucuauugcugggguuggauggacagcaggccuuagcuccuuugccgcuaucccauucgcccagucaauauuuuacagguugaauggugugggcauuacccaacagguacugucugaaaaccagaaguuaaucgcaaauaaauucaaccaggcgcucggggccaugcaaacuggauuuacaaccacuaaugaggcuuuccgcaaggugcaggacgccgucaacaacaaugcacaggcucugagcaaacuugccagugaacuguccaacaccuucggcgcaauuagcgccucuaucggggauauaauccagcgguuggacgugcucgagcaagaugcucagauugacagacugaucaauggaaggcuaacaacgcugaacgcguuuguugcccagcagcucgugcgcucagaguccgcagcucugagugcccaacuugccaaggauaaggucaaugaaugcgugaaagcucagagcaagcgaucgggcuucuguggucaggggacccacauuguuucuuuuguggucaacgcaccgaauggauuguauuucaugcauguaggcuacuauccuuccaaccacaucgaggugguuagcgccuacggucugugcgacgcggcuaaucccacuaacuguauagccccagugaauggcuacuuuauuaaaacaaacaauacccggaucgucgacgaauggucauauacagggaguucuuucuacgcacccgagccuaucacuuccuuaaacaccaaguauguggccccacagguaacguaccaaaauauuagcacaaacuugcccccuccgcugcuuggaaacucaaccggcaucgauuuucaggacgagcuggaugacuucuuuaagaaugugaguacuagcauuccaaacuucgggucccuaacccagauaaauacaacucuccuggauuugaccuaugaaaugcugucuuuacaacaggucguuaaagcucucaacgagagcuacaucgaccugaaggaacuuggaaauuauacauacuacaacaaauggcccugguauauuuggcugggcuuuaucgcagguuugguggcccucgcgcugugcguguucuuuauucuauguugcacgggguguggaaccaauugcaugggcaagcugaaaugcaaccguuguugcgauagauacgaggaauaugaccuugagccucauaagguccacgugcacuga

SEQ ID NO: 678 - RNA, 4062 nt, Artificial Sequence
  derived and/or modified CDS sequence (opt3) from MERS-CoV__AMW90853__S
augauccacagcguguuccugcucauguuucuucugacccccacagaguccuacgucgacguuggcucugauucagugaagagugccugcauugaaguagacauacagcaaacuuucuuugauaaaacguggccuagaccaaucgacgugagcaaggcugaugggauuaucuauccgcagggaaggaccuacuccaacauuacaaucacuuaucaggguuuguuccccuaccagggcgaccauggggauauguaugucuacucugcaggauaugccaccggcacaaccccucaaaaauuauuuguggcgaauuacucgcaggacguuaagcaguucgcuaacgguuuugugguccggauaggggccgcagccaauucaacuggaacagugaucauuagcccaaguaccuccgcuacgauccgcaaaauuuaccccgcauucaugcugggcucuagcguaggcaacuuuuccgaugggaagaugggacgauucuuuaaucacacucuaguucuccugccugacgguuguggcacccuucugcgugccuucuauugcaucuuggagccaagaucagggaaccauugucccgcuggaaauaguuacacuagcuuugccacauaucacaccccugcgacagauugcucugacggcaacuacaauaggaacgcaucccucaauucauucaaggaauauuucaaccugcggaauuguaccuuuauguacacguauaacauaacugaggaugaaauucuggagugguucgguaucacacagaccgcccaaggggugcaucucuuuagcagucgcuacgucgacuuauacggaggcaauauguuccaguuugcuacucugccaguguaugacacaauuaaauacuauucuaucaucccgcacuccauuagaagcauacagucggauaggaaggccugggcagcuuucuacguguauaaacuucagcccuugaccuuucugcuagacuucucugucgauggcuacauccggcgcgccauugacugcggguuuaacgaucucucccaacugcacuguucauaugagaguuucgacguugaaagcggaguguacuccguaucuagcuuugaggcgaagccuucagguaguguggucgaacaggccgagggcguggagugcgauuucuccccacuucugagcgggacgcccccucagguuuacaacuuuaaacgauugguguucaccaauuguaacuauaauuucacaaagcuccugucuuuauuuucagucaacgacuucacuugcagucaaaucagcccagcagcuauagccuccaauuguuacucuucgcugauucucgauuauuuuagcuacccccuuuccaugaagucagaccugagugugucuagcgcuggaccgaucucccaguucaacuauaaacagucauuuagcaauccuaccugcuugauccuagccacaguaccccauaaccugacuaccauuacaaagccacucaaauacucuuauaucaauaagugcuccagacugcuuagugaugacaggaccgaaguuccucagcuggugaacgcaaaucaauacagccccugugucucuauugugccauccacugucugggaggacggcgauuacuaucggaaacaguugucaccccucgaaggugggggcuggcugguggccaguggaagcacgguugcuaugacagagcaguuacagaugggcuucgggauaaccgugcaauacggaacugacaccaacucgguaugcccuaagcuggaauuugcgaaugauacaaaaaucgcaucccagcuagguaacugugucgaguauucucucuacggcgugagcgggcguggaguuuuccagaauugcaccgccgugggcguccgccagcaaagauuuguguaugacgcuuaccagaaccugguagguuauuacucagaugacgggaacuacuauugucuuagggccugcgugaguguuccagucuccgugauuuacgauaaggagacuaagacacacgcaacguuguucggcucuguggccugugaacauaucagcuccaccaugucacaguauagccggaguacucgaucuaugcugaaacgcagagacuccacauacggaccgcuccagacccccgucggcugcguucuggggcuugugaauagcucgcuguuuguggaggauuguaaguugccucucggacaaucacugugcgcuuuaccagacacacccucuacucugaccccuaggaguguacgguccgucccaggugaaaugcgccuagccagcaucgcauucaaccaccccauucagguggaucagcucaauucuagcuauuuuaaacuguccauaccgacgaacuucucauucggcguuacccaagaguacauccagacaacuauucagaaggugaccgucgacuguaaacaguaugugugcaauggguuucaaaagugcgaacagcuuuugagagaguacggacaguucuguaguaagaucaaccaggcgcugcacggcgcuaaucucaggcaagaugacagcguucguaaccuguuugccucugugaaauccucacagaguagcccuauuaucccagguuucgggggcgacuuuaauuuaacacugcuugagcccguauccauaucuacuggaucgcggagcgcacgaucagccaucgaagaucuucucuucgacaaggucaccauugcugauccuggcuacaugcagggguaugacgauugcaugcagcaaggacccgccuccgcaagagaccugaucugugcucaguacguggccggcuauaaagugcuaccaccucugauggaugucaacauggaggcggccuacacgaguucucuccuggguagcauugcugggguuggauggacagcaggccuuuccucauuugccgcuauccccuucgcccagucuauauuuuauagguugaauggugugggcauuacccaacagguacugagcgaaaaccagaaguuaaucgcaaauaaauucaaccaggcgcucggggccaugcaaacuggauuuacaaccacuaaugaggcuuuccgcaaggugcaggacgccgucaacaacaaugcacaggcucugaguaaguuggccuccgaacugagcaacaccuucggcgcaauuucugccucaaucggggauauaauccagcgguuggacgugcucgagcaagaugcucagauugacagacugaucaauggaaggcuaacaacgcugaacgcguuuguugcccagcagcucgugcgcuccgagagugcagcucugagcgcccaacuugccaaagauaaggucaaugaaugcgugaaagcucagucgaagcgaucuggcuucuguggucaggggacccauauuguuuccuuuguggucaacgcaccaaauggauuguacuucaugcacguaggcuauuacccgagcaaccauaucgaggugguuucagccuacggucugugcgacgcggcuaauccuacuaacuguauagcccccgugaauggcuauuuuauuaaaacaaacaauacccggaucgucgacgaauggaguuacacagggucuuccuucuaugcaccagagcccaucacuagcuuaaacaccaaguacguggccccucagguaacguaucaaaauauuucaacaaaccucccacccccucugcuuggaaacaguaccggcaucgauuuucaggacgagcuggaugaguucuuuaagaaugugagcacuuccauuccgaacuucgggucucuaacccagauaaauacaacucuccuggacuugaccuacgaaaugcugagcuuacaacaggucguuaaagcucucaacgaauccuauaucgaucugaaggagcuuggaaauuacacauacuauaacaaauggccaugguacauuuggcugggcuuuaucgcagguuugguggcccucgcgcugugcguguucuuuauucuauguugcacgggguguggaaccaauugcaugggcaagcugaaaugcaaccguuguugcgacagauaugaagaguacgaucuugagccccacaagguccaugugcacuga

SEQ ID NO: 679 - RNA, 4062 nt, Artificial Sequence
  derived and/or modified CDS sequence (opt3) from MERS-CoV__ANC28656__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgauggcaggaccgaaguuccccaguuggugaacgcaaaucaauauaguccaugugucagcauugugcccucuacugucugggaggacggugacuacuaccggaaacagcucuccccucuggaagggggcggaugguuaguggccucaggcaguacgguugcuaugacagagcagcugcagaugggguuuggaauaaccgugcaauaugguacugauaccaacagcguaugcccaaagcuagaguucgcgaaugacacaaaaaucgcaucgcagcucggcaacugugucgaauacucccuguauggggugucuggacguggcguuuuucagaauugcaccgccguggguguccgccagcaaagauucguguacgaugcuuaucagaaccuuguaggguacuauagcgacgauggcaacuacuacuguuugagggccugcgugucaguuccggucagugugauuuaugacaaggagacuaagacacaugcaacgcuguuuggauccguggccugugaacacaucucuagcaccaugucccaguacucacggagcacucgaaguaugcucaaacgcagagauucuacauauggcccccugcagaccccugucgggugcguucuuggacugguaaauuccagcuuguucguggaggacuguaagcucccacugggucaaucguuaugcgcucugcccgauacaccuucaacucuaaccccaaggucugugcggaguguccccggcgaaaugcgccucgccuccaucgcauuuaaccacccgauucagguggaccagcugaauagcucuuacuucaaacuuagcauaccuacgaacuuuuccuucgggguuacccaagaguauauccagacaacuauucagaaggugaccgucgauuguaaacaguacgugugcaauggauuccaaaagugcgaacaguugcugagagaguauggccaguuuuguucaaagaucaaccaggcgcuccauggugcuaaucugaggcaagacgauaguguucguaacuuauucgccagcgugaaaucuucccagucaaguccaauuauccccggguuuggcggagacuucaaucugacacuuuuggagccuguaagcauauccacuggcucucggucggcacgaagcgccaucgaagaccuccuguuugauaaggucaccauugcugaccccggguacaugcagggauacgaugacugcaugcagcaaggcccagccucagcaagagaucuaaucugugcucaguauguggccgguuacaaagugcugccuccccucauggacgucaacauggaggcggccuauacguccagucugcuugggucuauugcuggaguuggcuggacagcagguuugagcuccuucgccgcuaucccauuugcccagucaauauucuacaggcugaauggcguggggauuacccaacagguauuaucugaaaaccagaagcucaucgcaaauaaauuuaaccaggcgcugggagccaugcaaacuggcuucacaaccacuaaugaggcuuuucgcaaggugcaggaugccgucaacaacaaugcacaggcucuuagcaagcuggccagugaauuguccaacaccuucggggcaauuagcgccucuaucggagacauaauccagcggcucgaugugcuggagcaagacgcucagauugauagacuaaucaauggcaggcugacaacgcucaacgcguucguugcccagcagcuggugcgcucagaguccgcagcucuuagugcccaauuggccaaagacaaggucaaugaaugcgugaaagcucagagcaagcgaucggguuuuugugggcagggaacccacauuguuucuuucguggucaacgcaccgaauggccuguauuuuaugcauguagguuacuauccuuccaaccacaucgaggugguuagcgccuacggcuuaugcgaugcggcuaaucccacuaacuguauagccccagugaauggguacuucauuaaaacaaacaauacccggaucgucgacgaauggucauauacaggaaguucuuuuuacgcacccgagccuaucacuucccucaacaccaaguauguggccccacagguaacguaccaaaauauuagcacaaaccugcccccuccgcuucugggcaacucaaccgggaucgacuuccaggaugagcuagacgaauuuuucaagaaugugaguacuagcauuccaaacuuuggaucccucacccagauaaauacaacucuguuggaucugaccuaugagauguuaucucuccaacaggucguuaaagcucugaacgaaagcuacaucgaccuuaaggagcugggcaauuauacauacuacaacaaauggcccugguauauuugguuggguuucaucgcagggcucguggcccuggcgcuaugcguguuuuucauucuguguugcacgggauguggcaccaauugcauggguaaacuuaagugcaaccguuguugcgauagauacgaagaguaugaccucgagccucauaagguccacgugcacuga

SEQ ID NO: 680 - RNA, 4062 nt, Artificial Sequence
  derived and/or modified CDS sequence (opt3) from MERS-CoV__ANC28678__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuugcuccauacagagcgauagaaaggccugggcagcuuucuauguguacaaacuucagccuuugaccuuucugcuagacuucucggucgauggcuauaucaggcgggccauugacuguggguuuaacgaucucucucaacugcauugcuccuacgagucauucgacguugaaaguggaguguauagcguauccucuuuugaggcgaagccaagcgguucaguggucgaacaggccgagggcguggagugugauuucaguccccuucuguccgggacgccuccacagguuuacaacuuuaaacgcuugguguucaccaauugcaacuacaaucucacaaagcuguuaagccuguucucugucaacgacuuuacuuguucacaaaucagucccgcagcuauagccagcaauugcuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaaguguucucgacuucuguccgauggcagaaccgaaguuccccaguuggugaacgcaaaucaauauaguccaugcgucagcauugugcccucuacugucugggaggacggugacuacuacaggaaacagcucuccccucuggaagggggcggaugguuaguggccucaggcaguacgguugcuaugacagagcagcugcagaugggguuuggaauaaccgugcaauaugguacugauaccaacagcguauguccaaagcuagaguucgcgaaugacacaaaaaucgcaucgcagcucggcaacugcgucgaauacucccuguauggggugucuggacggggcguuuuucagaauuguaccgccguggguguccgucagcaacgcuucguguacgaugcuuaucagaaccuuguaggguacuauagcgacgauggcaacuacuacugcuugagagccugugugucaguuccggucagugugauuuaugacaaggagacuaagacacaugcaacgcuguuuggauccguggccugcgaacacaucucuagcaccaugucccaguacucaaggagcacucggaguaugcucaaacgacgcgauucuacauauggcccccugcagaccccugucggguguguucuuggacugguaaauuccagcuuguucguggaggacugcaagcucccacugggucaaucguuaugugcucugcccgauacaccuucaacucuaaccccaagaucugugaggaguguccccggcgaaaugcggcucgccuccaucgcauuuaaccacccgauucagguggaccagcugaauagcucuuacuucaaacuuagcauaccuacgaacuuuuccuucgggguuacccaagaguauauccagacaacuauucagaaggugaccgucgauugcaaacaguacgugugcaauggauuccaaaagugugaacaguugcugcgcgaguauggccaguuuugcucaaagaucaaccaggcgcuccauggugcuaaucugagacaagacgauaguguuaggaacuuauucgccagcgugaaaucuucccagucaaguccaauuauccccggguuuggcggagacuucaaucugacacuuuuggagccuguaagcauauccacuggcucucguucggcacggagcgccaucgaagaccuccuguuugauaaggucaccauugcugaccccggguacaugcagggauacgaugacuguaugcagcaaggcccagccucagcacgagaucuaaucugcgcucaguauguggccgguuacaaagugcugccuccccucauggacgucaacauggaggcggccuauacguccagucugcuugggucuauugcuggaguuggcuggacagcagguuugagcuccuucgccgcuaucccauuugcccagucaauauucuacagacugaauggcguggggauuacccaacagguauuaucugaaaaccagaagcucaucgcaaauaaauuuaaccaggcgcugggagccaugcaaacuggcuucacaaccacuaaugaggcuuuuaggaaggugcaggaugccgucaacaacaaugcacaggcucuuagcaagcuggccagugaauuguccaacaccuucggggcaauuagcgccucuaucggagacauaauccagcgccucgaugugcuggagcaagacgcucagauugaucggcuaaucaauggcagacugacaacgcucaacgcguucguugcccagcagcuggugaggucagaguccgcagcucuuagugcccaauuggccaaagacaaggucaaugaaugugugaaagcucagagcaagcgcucggguuuuugcgggcagggaacccacauuguuucuuucguggucaacgcaccgaauggccuguauuuuaugcauguagguuacuauccuuccaaccacaucgaggugguuagcgccuacggcuuaugugaugcggcuaaucccacuaacugcauagccccagugaauggguacuucauuaaaacaaacaauacccgaaucgucgacgaauggucauauacaggaaguucuuuuuacgcacccgagccuaucacuucccucaacaccaaguauguggccccacagguaacguaccaaaauauuagcacaaaccugcccccuccgcuucugggcaacucaaccgggaucgacuuccaggaugagcuagacgaauuuuucaagaaugugaguacuagcauuccaaacuuuggaucccucacccagauaaauacaacucuguuggaucugaccuaugagauguuaucucuccaacaggucguuaaagcucugaacgaaagcuacaucgaccuuaaggagcugggcaauuauacauacuacaacaaauggcccugguauauuugguuggguuucaucgcagggcucguggcccuggcgcuauguguguuuuucauucugugcuguacgggaugcggcaccaauugcauggguaaacuuaaguguaaccggugcugugaucguuacgaagaguaugaccucgagccucauaagguccacgugcacuga

SEQ ID NO: 681 - RNA, 4059 nt, Artificial Sequence
  derived and/or modified CDS sequence (opt3) from MERS-CoV__AHL18090__S
augauccacagcguguuccugcucauguuucuucugacccccacagaguccuacgucgacguuggcuuggauucugccaagucagcuugcauugaaguggacauacagcagacuuucuuugauaaaacguggccuagaccaaucgacguaaguaaggcagaugggauuaucuauccgcagggaaggaccuacagcaacauuacaaucacuuaucaggguuuauuccccuaccagggcgaccauggggauauguauguguacuccgccggacacgcgaccggcacaaccccucaaaaacuguuugucgcuaauuauucucaggacgugaagcaguucgccaacgguuuuguugugcggauaggggcagccgcuaauucgacuggaacagucaucauuucaccaagcaccagugcaacgauccgcaaaauuuaccccgccuucaugcuaggcuccucugugggcaacuuuagcgaugggaagaugggacgauucuuuaaucauacucucguacugcuuccugacgguuguggcacccuguugcgugcuuucuacugcauccucgagccaagauccgggaacuauugucccgccggaaauucauacacaaguuuugcgacuuaucacaccccugcaacagauugcagcgacggcaacuacaauaggaacgccucucucaauuccuucaaggaauauuucaaccugcggaauuguaccuuuauguacacguauaacauaacugaggaugaaauucucgagugguucgguaucacacagaccgcucaagggguucauuuauuuucaagccgcuacguggaccuguacggaggcaauauguuccaguuugccacucuuccagucuaugacacaauuaaauacuauaguaucaucccgcacucuauuagauccauacagagcgauaggaaggcaugggcugccuucuacguguauaaauugcagccccugaccuuucuacucgacuucucgguggauggcuacauccggcgcgcgauugacugcggguuuaacgaucugucucaacuucacuguuccuaugagucauucgacgucgaaaguggaguuuacagcguguccucuuuugaggccaagccuagcgguucaguaguggaacaggcagagggcgucgagugcgauuucaguccacuguuguccgggacgcccccucagguguacaacuuuaaacgacucguuuucaccaauuguaacuauaaucugacaaaguuacugagccucuucucugugaacgacuuuacuugcucacaaaucaguccagcugccauaagcuccaauuguuacucuucgcuuauucuggauuauuucagcuaccccuuguccaugaagucagaccuaagugucucuagcgcuggaccgaucucccaguuuaacuauaaacagucauucagcaauccuaccugccugauccucgccacagugccccauaaccugacuaccauuacaaagccacuuaaauacucuuauaucaauaagugcuccagacuguugagugaugacaggaccgaaguaccucagcucguuaacgcaaaucaauacagccccugugugucuauugucccauccacugugugggaggacggcgauuacuaucggaaacagcugucacccuuagaaggugggggcuggcuggucgccaguggaagcacgguggcuaugacagagcagcuacagaugggcuuugggauaaccguucaauacggaacugacaccaacucggugugcccuaagcucgaguucgcgaaugauacaaaaaucgcaucccagcuggguaacuguguagaauauucucuuuacggcgucagcgggcguggaguguuucagaauugcaccgccguuggcgugcgccagcaaagauucgucuaugacgcuuaccagaacuugguggguuauuacucagaugacgggaacuacuauugucugagggccugcguaagugugccaguuuccgucauuuacgauaagaagacuaaaacacacgcaacgcucuuuggcucuguggccugugagcauaucagcuccaccaugucacaguauagccggaguacucgaucuacacugaagcgcagagacuccaccuacggaccgcuucagacacccgugggcugcguccugggguugguuaauagcucgcuguucguggaagauuguaaacugccuuuaggacaaucacugugcgcucuaccagacacucccucuacccucacgccuaggagugugcgguccguaccaggucagaugcgccuggccagcaucgcauuuaaccaccccauucaggucgaucaacuuaauucuagcuauuucaaguuguccauaccgaccaacuuuucauucggcgugacacaggaguacauccagacuaccauucagaaaguuacaguggacuguaagcaauaugucugcaauggguuccagaagugcgaacagcugcucagagaguacggacaguuuuguaguaaaaucaaccaagcgcugcacggcgcuaauuuaaggcaggaugacagcgugcguaaccuguucgccucuguuaaguccucacagaguagcccuauuaucccagguuuugggggcgacuucaaucuuacuuugcucgaacccguguccauaucuaccggaucgcggagcucacgaaucgcaauugaggaucugcuauuugacaaaguaacgaucgccgauccuggcuacaugcagggguaugacgauugcaugcaacagggacccuccagugcuagagaccugauuugugcccaguacgucgcaggcuauaaggugcucccaccucugauggaugugaacauggaggcugccuacacaucuagccuuuuggguuccaucgcgggggucggauggaccgccggccugucaucuuucgcugcaauacccuuugcccaaagcauuuucuauagguuaaaugguguuggcaucacucaacaggugcucagugaaaaccagaaacugauugcuaauaaguuuaaccaggcccuuggggcaaugcagacaggauucaccacuaccaaugaggcguuucagaagguacaggacgccgugaacaacaaugcucaagcccuguccaaauuggcaagcgaacucucuaacacauucggcgcuaucucagccuccauaggggauaucauucagcgccuggacguccuagagcaggaugcacagaucgaccggcugauuaauggaagacucacgacccugaacgccuucguggcucaacagcuuguuaggagugaaagcgcggccuugucggcacagcuggcuaaggauaaagugaaugagugcgucaaggcccagucuaaacgcuccggcuuuuguggucaagggacucauaucgugagcuucguugugaacgccccaaauggauuauacuuuaugcacgucggcuauuacccgucaaaccauauagagguagugagugcuuacggucucugcgacucugcaaauccuacaaacuguauugcccccguuaauggcuauuucaucaagaccaacaauacacgaaucguggacgaaugguccuacacugggagcucauuuuaugcgccagagcccauuaccagucugaacacgaaguacgucgcuccucaggugacauaucagaauaucagcaccaaccuuccacccccucugcuaggaaacuccacuggcauugauuuccaagacgaacucgaugaguuuuucaaaaauguaucuaccagcauaccgaacuuugggucccugacacagaucaauacuaccuugcuggacuuaacauacgagaugcucucacugcaacagguggucaaggcccuuaacgaaucuuauauugaucugaaagaguugggaaauuacacguacuauaaguggccaugguacaucuggcucggcuucauugcaggucugguugcccuagcucugugcguguuuuucauccuuuguugcaccggguguggaacuaacugcaugggcaaacucaagcggaaucguugcugugacagauaugaagaguacgaucuggaaccccacaaagugcauguccacuga

SEQ ID NO: 682 - RNA, 4062 nt, Artificial Sequence
  derived and/or modified CDS sequence (opt3) from MERS-CoV__AHX00731__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugggagugucaagugcuggcccuaucucucaguuuaacuacaaacagagcuucuccaauccaaccugccuaauccuggccacaguaccccacaaccucacuaccauuacaaagccucugaaauauucauacaucaauaagugcagcagacuucugucugaugacaggaccgaaguuccccaguuggugaacgcaaaucaauauuccccaugugucaguauugugcccagcacugucugggaggacggugauuacuaccggaaacagcucucuccucuggaagggggcggaugguuaguggccuccggcucaacgguugcuaugacagagcagcugcagaugggguuuggaauaaccgugcaauaugguacugacaccaacaguguaugcccaaagcuagaauuugcgaaugauacaaaaaucgcaagccagcucggcaacugugucgaguacucgcuguaugggguguccggacguggcguuuuucagaauugcaccgccguggguguccgccagcaaagauucguguacgacgcuuaucagaaccuuguaggguacuauucugaugacggcaacuacuacuguuugagggccugcgugagcguuccggucucagugauuuaugauaaggagacuaagacacaugcaacgcuguuuggaaguguggccugugaacacaucuccucuaccaugagccaguacucccggucaacucgaagcaugcucaaacgcagagacaguacauauggcccccugcagaccccugucgggugcguucuuggacugguaaauucuuccuuguucguggaggauuguaagcucccacugggucaaagccucugcgcucugcccgacacaccuucgacucuaaccccaaggucagugcggucuguccccggcgaaaugcgccucgccaguaucgcauuuaaccacccgauucagguggaucaguucaauuccagcuacuuuaaacugucuauaccuacgaacuucagcuucgggguuacccaagaguauauccagacaacuauucagaaggugaccgucgacuguaaacaguacaucugcaauggauuucaaaagugcgaacagcuuuugagagaguauggccaguucuguuccaagauuaaccaggcgcugcauggugcuaaucucaggcaagaugacucagugcguaaccuguuugccaguguuaaaagcucucaguccucaccaaucauacccggguucggcggagacuuuaauuuaacacugcuugagccugugaguaucagcacuggcucccggucugcacgaucggccauugaagaucuucucuucgacaagguaaccaucgcugaucccggguacaugcagggauacgacgauugcaugcagcaaggcccagccagcgcaagagaccugauuugugcucaguaugucgccgguuacaaagugcuaccuccccugauggaugugaacauggaggcggccuauacgucaucccuccuggggaguaucgcuggagucggcuggacagcaggucuuucuagcuuugccgcuauaccauucgcccaguccauuuucuacagguugaauggcguugggaucacccaacaggugcugucagaaaaccagaaguuaauugcaaauaaauucaaccaggcgcucggagccaugcaaacuggcuuuacaaccacuaaugaggcuuuccgcaagguacaggacgccgugaacaacaaugcacaggcucugucuaaguuggccagcgaacugaguaacaccuucggggcaaucuccgccagcauaggagauaucauucagcgguuggacguccucgagcaagaugcucagaucgacagacugauuaauggcaggcuaacaacgcugaacgcguuuguggcccagcagcucguucgcucugagucagcagcucuguccgcccaacuugccaaagauaaggugaaugaaugcgucaaagcucagaguaagcgaagcgguuucugugggcagggaacccacaucgugucguuuguugugaacgcaccgaauggcuuguauuucaugcaugucgguuacuauccuucuaaccacauagagguaguguccgccuacggccugugcgacgcggcuaaucccacuaacuguauugccccaguuaauggguacuuuaucaaaacaaacaauacccggaucguggacgaauggagcuauacaggaucaaguuucuacucucccgagccuauuacuuccuuaaacaccaaguaugucgcaccacaggugacguaccaaaauaucagcacaaacuuacccccuccgcugcuuggcaacucaaccgggauugauuuucaggacgagcuggaugaguucuuuaagaauguaaguacuagcauaccaaacuucggaucccuaacccagaucaauacaacucuccuggacuugaccuaugaaaugcugucuuuacaacagguggucaaagcccucaacgaaagcuacauugaucugaaggagcuuggcaauuauacauacuacaacaaauggcccugguauaucuggcuggguuuuauugcuggguugguugcacucgcccugugcguguucuuuauccuauguugcacgggauguggcaccaauugcauggguaagcugaaaugcaaccguuguugcgacagauacgaagaguaugaucuugagccucauaaggugcacguccacuga

SEQ ID NO: 683 - RNA, 4062 nt, Artificial Sequence
  derived and/or modified CDS sequence (opt3) from MERS-CoV__AHX71946__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucacauacaaguuuugccacuuaucacaccccagcgacagauugcagcgacggcaacuacaauaggaacgcaucucucaauuccuucaaggaauauuucaaccugcggaauuguaccuuuauguacacguauaacauaacugaggaugaaauucuggagugguucgguaucacacagaccgcccaaggggugcaccucuuuucaagccgcuacgucgacuuauauggaggcaauauguuccaguuugcuacucugccgguguacgacacaauuaaauacuauaguaucaucccccauucuauuagauccauacagagcgauaggaaggccugggcagcuuucuacguguauaaacuucagccuuugaccuuucugcuagacuucucggucgauggcuacauccggcgcgccauugacugcggguuuaacgaucucucucaacugcacuguuccuaugagucauucgacguugaaaguggaguguacagcguauccucuuuugaggcgaagccaagcgguucaguggucgaacaggccgagggcguggagugcgauuucaguccccuucuguccgggacgccuccacagguuuauaacuuuaaacgauugguguucaccaauuguaacuacaaucucacaaagcuguuaagccuguucucugucaacgacuuuacuugcucacaaaucagucccgcagcuauagccagcaauuguuacuccucucucauucuugauuauuucucguacccgcugagcaugaaguccgacuugucagugaguucugcuggaccuaucagccaguuuaacuauaaacaguccuucucaaauccaaccugccuaauccuggccacaguaccccauaaccucacuaccauuacaaagccucugaaauacagcuauaucaauaagugcucuagacuucuguccgaugacaggaccgaaguuccccaguuggugaacgcaaaucaauacaguccaugugucagcauugugcccucuacugucugggaggacggcgauuauuaccggaaacagcucuccccucuggaaggugggggcugguuaguggccucaggaaguacgguugcuaugacagagcagcugcagaugggcuuugggauaaccgugcaauacggaacugacaccaacagcguaugcccaaagcuagaguucgcgaaugauacaaaaaucgcaucgcagcucgguaacugugucgaauauucccuguacggcgugucugggcguggaguuuuucagaauugcaccgccgugggcguccgccagcaaagauucguguaugacgcuuaccagaaccuuguagguuauuacagcgaugacgggaacuauuacuguuugagggccugcgugucaguuccggucagugugauuuacgauaaggagacuaagacacacgcaacgcuguuuggcuccguggccugugaacacaucucuagcaccaugucccaguauucacggagcacucgaaguaugcucaaacgcagagacucuacauacggaccccugcagaccccugucggcugcguucuugggcugguaaauuccagcuuguucguggaggauuguaagcucccacugggacaaucguuaugcgcucugcccgacacaccuucaacucuaaccccaaggucugugcggaguguccccggugaaaugcgccucgccuccaucgcauuuaaccauccgauucagguggaucagcugaauagcucuuauuucaaacuuagcauaccuacgaacuuuuccuucggcguuacccaagaguacauccagacaacuauucagaaggugaccgucgacuguaaacaguaugugugcaauggguuccaaaagugcgaacaguugcugagagaguacggacaguuuuguucaaagaucaaccaggcgcuccacggcgcuaaucugaggcaagaugacaguguucguaacuuauucgccagcgugaaaucuucccagucaaguccaauuauccccgguuuugggggcgacuucaaucugacacuuuuggagccuguaagcauauccacuggaucucggucggcacgaagcgccaucgaagaucuccuguuugacaaggucaccauugcugaucccggcuauaugcagggguacgacgauugcaugcagcaaggaccagccucagcaagagaccuaaucugugcucaguacguggccggcuauaaagugcugccuccccucauggaugucaacauggaggcggccuacacguccagucugcuugguucuauugcugggguuggauggacagcaggcuugagcuccuucgccgcuaucccauuugcccagucaauauucuauaggcugaauggugugggcauuacccaacagguauuaucugaaaaccagaagcucaucgcaaauaaauuuaaccaggcgcugggggccaugcaaacuggauucacaaccacuaaugaggcuuuucgcaaggugcaggacgccgucaacaacaaugcacaggcucuuagcaagcuggccagugaauuguccaacaccuucggcgcaauuagcgccucuaucggggauauaauccagcggcucgacgugcuggagcaagaugcucagauugacagacuaaucaauggaaggcugacaacgcucaacgcguucguugcccagcagcuggugcgcucagaguccgcagcucuuagugcccaauuggccaaagauaaggucaaugaaugcgugaaagcucagagcaagcgaucgggcuuuuguggucaggggacccauauuguuucuuucguggucaacgcaccgaauggacuguacuuuaugcacguaggcuauuacccuuccaaccauaucgaggugguuagcgccuaugguuuaugcgacgcggcuaaucccacuaacuguauagccccagugaauggcuacuucauuaaaacaaacaauacccggaucgucgacgaauggucauacacagggaguucuuuuuaugcacccgagccuaucacuucccucaacaccaaguacguggccccacagguaacguaucaaaauauuagcacaaaccugcccccuccgcuucugggaaacucaaccggcaucgauuuccaggacgagcuagaugaauuuuucaagaaugugaguacuagcauuccaaacuuugggucccucacccagauaaauacaacucuguuggaccugaccuacgagauguuaucucuccaacaggucguuaaagcucugaacgaaagcuauaucgaucuuaaggagcugggaaauuacacauauuacaacaaauggcccugguacauuugguugggcuucaucgcaggucucguggcccuggcgcuaugcguguuuuucauucuguguugcacgggguguggaaccaauugcaugggcaaacuuaagugcaaccguuguugcgacagauaugaagaguacgaucucgagccucacaagguccacgugcauuga

SEQ ID NO: 684 - RNA, 4062 nt, Artificial Sequence
  derived and/or modified CDS sequence (opt3) from MERS-CoV__AHY22545__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaucgauugguguucaccaacuguaauuacaaccucacaaaacuguuaagccuguucucugucaaugacuuuacuugcucacaaaucagucccgcagcuauagccagcaacuguuauuccucucucauucuugauuacuucucguauccgcugagcaugaaguccgacuugucagugaguucugcuggaccuaucagccaguuuaauuacaagcaguccuucucaaacccaaccugccuaauccuggccacaguaccccacaaucucacuaccauuacaaaaccucugaaguauagcuacaucaacaaaugcucuagacuucuguccgaugacaggaccgaaguuccccaguuggugaaugcaaaccaauauaguccaugugucagcauugugcccucuacugucugggaggacggcgauuacuaccggaagcagcucuccccucuggaaggugggggcugguuaguggccucaggaaguacgguugcuaugacagagcagcugcagaugggcuuugggauaaccgugcaauauggaacugacaccaauagcguaugcccaaaacuagaguucgcgaacgauacaaagaucgcaucgcagcucgguaauugugucgaauacucccuguauggcgugucugggcguggaguuuuucagaacugcaccgccgugggcguccgccagcaaagauucguguacgacgcuuaucagaaccuuguagguuacuauagcgaugacgggaauuacuacuguuugagggccugcgugucaguuccggucagugugauuuaugauaaagagacuaagacacaugcaacgcuguuuggcuccguggccugugaacacaucucuagcaccaugucccaguacucacggagcacucgaaguaugcucaagcgcagagacucuacauauggaccccugcagaccccugucggcugcguucuugggcuggugaacuccagcuuguucguggaggauuguaaacucccacugggacaaucguuaugcgcucugcccgacacaccuucaacucuaaccccaaggucuguacggaguguccccggugaaaugcgccucgccuccaucgcauuuaaucacccgauucagguggaucagcugaacagcucuuacuucaaacuuagcauaccuacgaauuuuuccuucggcguuacccaagaguauauccagacaacuauucagaaggugaccgucgacuguaagcaguacgugugcaacggguuccaaaaaugcgaacaguugcugagagaguauggacaguuuuguucaaagaucaaucaggcgcuccauggcgcuaaccugaggcaagaugacaguguucguaauuuauucgccagcgugaagucuucccagucaaguccaauuauccccgguuuugggggcgacuucaaccugacacuuuuggagccuguaagcauauccacuggaucucggucggcacgaagcgccaucgaagaucuccuguuugacaaagucaccauugcugaucccggcuacaugcagggguacgacgauugcaugcagcaaggaccagccucagcaagagaccuaaucugugcucaguauguggccggcuacaaggugcugccuccccucauggaugucaauauggaggcggccuauacguccagucugcuugguucuauugcugggguuggauggacagcaggcuugagcuccuucgccgcuaucccauuugcccagucaauauucuacaggcugaacggugugggcauuacccaacagguauuaucugaaaaucagaaacucaucgcaaacaaguuuaaucaggcgcugggggccaugcaaacuggauucacaaccacuaacgaggcuuuucgcaaagugcaggacgccgucaacaauaacgcacaggcucuuagcaagcuggccagugaauuguccaauaccuucggcgcaauuagcgccucuaucggggauauaauccagcggcucgacgugcuggagcaagaugcucagauugacagacuaaucaacggaaggcugacaacgcucaaugcguucguugcccagcagcuggugcgcucagaguccgcagcucuuagugcccaauuggccaaggauaaagucaacgaaugcgugaaggcucagagcaaacgaucgggcuuuuguggucaggggacccacauuguuucuuucguggucaaugcaccgaacggacuguauuuuaugcauguaggcuacuauccuuccaaucacaucgaggugguuagcgccuacgguuuaugcgacgcggcuaaccccacuaauuguauagccccagugaacggcuacuucauuaagacaaauaacacccggaucgucgacgaauggucauauacagggaguucuuuuuacgcacccgagccuaucacuucccucaauaccaaauauguggccccacagguaacguaccaaaacauuagcacaaaccugcccccuccgcuucugggaaauucaaccggcaucgauuuccaggacgagcuagaugaauuuuucaagaacgugaguacuagcauuccaaauuuugggucccucacccagauaaacacaacucuguuggaccugaccuaugagauguuaucucuccaacaggucguuaaggcucugaaugaaagcuacaucgaucuuaaagagcugggaaacuauacauacuacaauaaguggcccugguauauuugguugggcuucaucgcaggucucguggcccuggcgcuaugcguguuuuucauucuguguugcacgggguguggaaccaacugcaugggcaaacuuaagugcaaucguuguugcgacagauacgaagaguaugaucucgagccucauaaaguccacgugcacuga

SEQ ID NO: 685 - RNA, 4062 nt, Artificial Sequence
  derived and/or modified CDS sequence (opt3) from MERS-CoV__AHY22555__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaauuacacucuaguucuccugccagacgguuguggcacccuucugcgugccuucuauugcaucuuggagcccagauccgggaaccauuguccugcuggaaauucauacacaaguuuugccacuuaucacaccccagcgacagauugcagcgacggcaacuacaauaggaacgcaucucucaauuccuucaaggaauauuucaaccugcggaauuguaccuuuauguacacguauaacauaacugaggaugaaauucuggagugguucgguaucacacagaccgcccaaggggugcaucucuuuucaagccgcuacgucgacuuauacggaggcaauauguuccaguuugcuacucugccgguguaugacacaauuaaauacuauaguaucaucccccacucuauuagauccauacagagcgauaggaaggccugggcaucguucuacguguauaaacuucagccuuugaccuuucugcuagacuucucugucgauggcuacauccggcgcgcuauugacugcggguuuaacgaucucucccaacugcacuguucauaugagaguuucgacguugaaagcggaguguacuccguaucuagcuuugaggccaagccaucagguaguguggucgaacaggcggagggcguggagugcgauuucagcccccuucuguccgggacgccuccacagguuuacaacuuuaaacgauugguguucaccaauuguaacuauaaucucacaaagcuguuaucucuguucucagucaacgacuuuacuugcagucaaaucagccccgccgcaauagcuuccaauuguuacucuucgcucauucuugauuauuucagcuacccgcuguccaugaagucagacuugagugugucuagcgccggaccuaucucccaguuuaacuauaaacagucauucagcaauccaaccugccuaauccuggcuacaguaccccauaaccucacuaccauuacaaagccucugaaauacucuuauaucaauaagugcuccagacuucugagugaugacaggaccgaaguuccccaguuggugaacagcaaucaauacucuccaugugucuccauugugcccucaacugucugggaggacggcgauuacuaucggaaacagcucaguccucuggaaggugggggcugguuaguggccagcggaucgacgguugcaaugacagagcagcugcagaugggcuuugggauaaccgugcaauacggaacugacaccaacuccguaugcccaaagcuagaguucgccaaugauacaaaaaucgcuucucagcucgguaacugugucgaauauagccuguacggcgugucagggcguggaguuuuucagaauugcaccgcggugggcguccgccagcaaagauucguguaugacgcauaccagaaccuuguagguuauuacagugaugacgggaacuacuauuguuugagggccugcguguccguuccggucucugugauuuacgauaaggagacuaagacacacgcuacgcuguuuggcagcguggccugugaacauaucuccucaaccaugagccaguauagucggucuacucgauccaugcucaaacgcagagacagcacauacggaccccugcagaccccugucggcugcguucuugggcugguaaauucgucauuguucguggaggauuguaagcucccacugggacaaucuuuaugcgcacugcccgacacaccuaguacucuaaccccaagguccgugcggagcguccccggugaaaugcgccucgccucuaucgcuuuuaaccacccgauucagguggaucagcugaauagcuccuauuucaaacuuucaauaccuacgaacuuuaguuucggcguuacccaagaguacauccagacaacuauucagaaggugaccgucgacuguaaacaguaugugugcaauggguuccaaaagugcgaacaguugcugagagaguacggacaguuuuguagcaagaucaaccaggcccuccacggcgcaaaucugaggcaagaugacucuguucguaacuuauucgcguccgugaaaucaagucagagcuccccaauuauccccgguuuugggggcgacuucaaucugacacuuuuggagccuguaucuauaucgacuggaagccggucagcucgauccgccaucgaagaucuccuguuugacaaggucaccauugcagaucccggcuacaugcagggguaugacgauugcaugcagcaaggaccagccagugcuagagaccuaaucugugcccaguacguggcaggcuauaaagugcugccuccccucauggaugucaacauggaggcugccuacacgucuagccugcuugguuccauugcggggguuggauggacagccggcuugucaucuuucgcugcaaucccauuugcccagagcauauucuauaggcugaauggugugggcauuacccaacagguauuaagugaaaaccagaagcucaucgcuaauaaauuuaaccaggcccugggggcaaugcaaacuggauucacaaccacuaaugaggcguuucauaaggugcaggacgccgucaacaacaaugcucaggcccuuuccaagcuggcaagcgaauugucuaacaccuucggcgcuauuucagccuccaucggggauauaauccagcgccucgacgugcuggagcaagaugcacagauugaccggcuaaucaauggaagacugacaacgcucaacgccuucguugcucagcagcuggugaggagugagagcgcggcccuuucggcacaauuggcuaaagauaaggucaaugaaugcgugaaagcccagucuaagcgcuccggcuuuuguggucaggggacccacauuguuagcuucguggucaacgccccgaauggacuguacuuuaugcauguaggcuauuacccuucaaaccacaucgaggugguuagugcuuacgguuuaugcgacgcagccaaucccacuaacuguauagcgccagugaauggcuauuucauuaaaacaaacaauacccgaaucgucgacgaauggucuuacacaggguccagcuuuuaugcucccgagccuaucacuucacucaacaccaaguacguggccccacagguaacguaucaaaauauuaguacaaaccugcccccuccgcuucugggaaacagcaccggcaucgauuuccaggacgagcuagaugaauuuuucaagaauguguccacuucuauuccaaacuuugggagccucacccagauaaauacaacucuguuggaccugaccuacgagauguuaucccuccaacaggucguuaaagcacugaacgaaucauauaucgaucuuaaggagcugggaaauuacacauacuauaacaaauggcccugguacauuugguugggcuucaucgccggucucguggcucuggcacuaugcguguuuuucauucuguguugcacgggguguggaaccaauugcaugggcaaacuuaagugcaaccgguguugcgaccguuaugaagaguacgaucucgagccucauaagguccacgugcacuga

SEQ ID NO: 686 - RNA, 4062 nt, Artificial Sequence
  derived and/or modified CDS sequence (opt3) from MERS-CoV__AHY22565__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuaucauucgcaaaaucuacccugcauucaugcugggcuccucuguaggcaacuuuagcgaugggaagaugggacgauucuuuaaucauacgcuaguucuccugccagacgguuguggcacucuucugcgugccuucuacugcauauuggagcccagauccgggaaccacuguccugcuggaaauucauauaccaguuuugccacauaccauacuccagcgaccgauugcagcgacggcaacuauaauaggaacgcaucucucaauuccuucaaggaauacuucaaccugcggaauuguacauuuauguauaccuacaacauuacggaggaugaaauccuggagugguucgguauuacucagacagcccaaggggugcaccucuuuucaagccgcuaugucgacuuauacggaggcaauauguuccaguuugcuacccugccgguguacgacacuaucaaauauuacaguaucauuccccacucuauaagauccauccagagcgauaggaaggccugggcaucguucuauguguacaaacuucagccuuugacauuucugcuagacuucucugucgauggcuauauucggcgcgcuaucgacugcggguuuaacgaucucucccaacugcauuguucauacgagaguuucgacguugaaagcggaguguauuccguaucuagcuuugaggccaagccaucagguaguguggucgaacaggcggagggcguggagugcgauuucagcccccuucuguccgggaccccuccacagguuuacaacuuuaaacgauugguguucacgaauuguaacuacaaucucaccaagcuguuaucucuguucucagucaacgacuuuacaugcagucaaauaagccccgccgcaauugcuuccaauuguuauucuucgcucauccuugauuacuucagcuauccgcuguccaugaagucagacuugagugugucuagcgccggaccuaucucccaguuuaacuacaaacagucauucagcaaucccacuugccuaauucuggcuaccguaccacacaaccucacaacuaucaccaagccucugaaauauucuuacauuaauaagugcuccagacuucugagugaugacaggacagaaguuccccaguuggugaacgccaaucaauauagcccaugugucucuauagugcccuccaccgucugggaggacggcgauuacuaccggaaacagcucucaccucuggaaggugggggcugguuaguggcaaguggaagcacuguugccaugacggagcagcugcagaugggcuuugggaucacagugcaauauggaaccgacacuaacucgguaugcccaaagcuagaguucgcuaaugauaccaaaauugcgucccagcucgguaacugugucgaauacucucuguauggcgugagcgggcguggaguuuuucagaauugcacagcagugggcguccgccagcaaagauucguguacgacgccuaucagaaccuuguagguuacuauucagaugacgggaacuacuacuguuugagggcuugcgugaguguuccggucuccgugaucuaugauaaggagaccaagacucaugccacacuguuuggcucuguggcaugugaacacaucagcuccacgaugucacaguacagccggaguacccgaucuaugcucaaacgcagagacuccacuuauggaccccugcagacaccugucggcugcguucuugggcuggugaauagcucguuguucguggaggauuguaagcucccacugggacaaucauuaugcgcccugcccgacaccccuucuacacuaacuccaaggaguguacgguccguccccggugaaaugcgccucgcuagcauugccuuuaaccacccgauacagguggaucagcuuaauucuagcuacuucaaacuuuccaucccuaccaacuuuucauucggcguuacgcaagaguauauucagaccacaauccagaaggugacugucgacuguaaacaguacgugugcaauggguuccaaaagugcgaacaguugcugagagaguauggacaguuuuguaguaagauuaaccaggcacuccauggcgcgaaucugaggcaagaugacagcguucguaacuuauucgcuucugugaaauccucacagaguagcccaaucauacccgguuuugggggcgacuucaaucugacccuuuuggagccuguauccaucucuacaggaucgcggagcgcccgaucagcaauugaagaucuccuguuugacaaggucacuaucgccgaucccggcuacaugcagggguacgacgauugcaugcagcaaggaccagcuuccgccagagaccuaauuugugcacaguauguggcuggcuacaaagugcugccuccccucauggaugucaacauggaggccgcguauaccaguucucugcuugguagcaucgccgggguuggauggacggcuggcuuguccucauucgcagccauaccauuugcucagucuauuuucuacaggcugaauggugugggcaucacacaacagguauuaagcgaaaaccagaagcucauugccaauaaauuuaaccaggcacugggggcgaugcaaaccggauucacuacaaccaaugaggccuuucgcaaggugcaggacgcugucaacaacaaugcccaggcacuuaguaagcuggcuuccgaauugagcaacacuuucggcgccaucucugcaucaauaggggauaucauucagcggcucgacgugcuggagcaagaugcccagaucgacagacuaauuaauggaaggcugaccacacucaacgcuuucguugcgcagcagcuggugcgcuccgagagugccgcacuuagcgcucaauuggccaaagauaaggucaaugaaugcgugaaagcccagucgaagcgaucuggcuuuuguggucaggggacgcacaucguuuccuucguggucaacgcuccgaauggacuguauuuuaugcauguaggcuacuauccuagcaaccacauagaggugguuucagcauacgguuuaugcgacgccaguaaucccaccaacuguauugcgccagugaauggcuacuucaucaaaacuaacaauacacggaucgucgacgaauggucuuauaccggguccagcuuuuacucacccgagccuauuacaagucucaacacuaaguauguggcuccacagguaaccuaccaaaauaucagcacgaaccugcccccuccgcuucugggaaacuccacaggcauugauuuccaggacgagcuagaugaauuuuucaagaaugugucuaccagcauaccaaacuuugggucccucacucagaucaauaccacacuguuggaccugacuuaugagauguuaucacuccaacaggucguuaaagcccugaacgaaucuuacauugaucuuaaggagcugggaaauuauaccuacuacaacaaauggcccugguauaucugguugggcuucauugcaggucucguggcccuggcucuaugcguguuuuucauccuguguugcacaggguguggaacgaauugcaugggcaagcugaaaugcaaccguuguugcgacagauacgaagaguaugaucucgagccucauaagguccacgugcacuga

SEQ ID NO: 687 - RNA, 4062 nt, Artificial Sequence
  derived and/or modified CDS sequence (opt3) from MERS-CoV__AJG44069__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacggaaauuauuuguggcgaauuauucucaagacguuaagcaguucgcuaacgguuuugugguccgcauaggggccgcagccaauucgacuggaacagugaucauuucacccagcaccagugcuacgauccgaaaaauuuacccugcauucaugcugggcuccucuguaggcaacuuuagcgaugggaagaugggacguuucuuuaaucauacucuaguucuccugccagacgguuguggcacccuucugagagccuucuacugcaucuuggagcccagguccgggaaccacuguccugcuggaaauucauauacaaguuuugccacuuaccauaccccagcgacagauugcagcgacggcaacuauaaucggaacgcaucucucaauuccuucaaggaauacuucaaccugcgcaauuguaccuuuauguauacguacaacauaacugaggaugaaauucuggagugguucgguaucacacagaccgcccagggggugcaccucuuuucaagcagauaugucgacuuauacggaggcaauauguuccaauuugcuacucugccgguguacgacacaauuaaauauuacaguaucaucccccacucuauuagguccauacagagcgaucggaaggccugggcagcuuucuauguguacaaacuucagccuuugaccuuucugcuagacuucucggucgauggcuauauccgccgagccauugacugcggguuuaacgaucucucucagcugcauuguuccuacgagucauucgacguugaaaguggaguguauagcguauccucuuuugaggcgaagccaagcgguucaguggucgaacaagccgagggcguggagugcgauuucaguccccuucuguccgggacgccuccacagguuuacaacuuuaaaagauugguguucaccaauuguaacuacaaucucacaaagcuguuaagccuguucucugucaacgacuuuacuugcucacagaucagucccgcagcuauagccagcaauuguuauuccucucucauucuugauuacuucucguauccgcugagcaugaaguccgacuugucagugaguucugcuggaccuaucagccaauuuaacuacaaacaguccuucucaaauccaaccugccuaauccuggccacaguaccccacaaccucacuaccauuacaaagccucugaaauauagcuacaucaauaagugcucuaggcuucuguccgaugaccggaccgaaguuccccaguuggugaacgcaaaucaguauaguccaugugucagcauugugcccucuacugucugggaggacggcgauuacuaccguaaacaacucuccccucuggaaggugggggcugguuaguggccucaggaaguacgguugcuaugacagagcagcugcagaugggcuuugggauaaccgugcaguauggaacugacaccaacagcguaugcccaaagcuagaguucgcgaaugauacaaaaaucgcaucgcaacucgguaacugugucgaauacucccuguauggcgugucugggcgcggaguuuuucagaauugcaccgccgugggcgucagacagcagagguucguguacgacgcuuaucaaaaccuuguagguuacuauagcgaugacgggaacuacuacuguuugcgggccugcgugucaguuccggucagugugauuuaugauaaggagacuaagacacaugcaacgcuguuuggcuccguggccugugaacacaucucuagcaccaugucccaguacucacgaagcacucgcaguaugcucaaaagaagggacucuacauauggaccccugcagaccccugucggcugcguucuugggcugguaaauuccagcuuguucguggaggauuguaagcucccacugggacagucguuaugcgcucugcccgacacaccuucaccacuaacuccccggucugugcgcagugucccgggugaaaugagacucgccuccaucgcauuuaaccacccuauucaaguggaucagcugaauagcucuuacuucaaacuuagcauaccaaccaacuuuuccuucggcguuacgcaggaguauauccaaaccacaauucagaaggugacugucgacuguaaacaguacaucugcaauggguuccagaagugcgaacaauugcugagggaguauggacaguuuuguucaaagauuaaccaggcgcuccauggcgcuaaucugcgucaggaugacagugugcggaacuuauucgccagcguuaaaucuucccaaucaagucccaucauaccugguuuugggggcgacuucaaucugacccuuuuggagcccgugagcaucuccacaggaucucgaucggcaagaagcgccauugaagaucuccuguuugacaagguaacuaucgcugauccaggcuacaugcagggguacgacgauugcaugcagcagggaccugccucagcaagggaccuaauuugugcucaauaugucgccggcuacaaagugcugcccccacucauggaugugaacauggaggcggccuauaccuccagucugcuugguucuaucgcuggggucggauggacggcaggcuugagcuccuucgccgcuauaccguuugcccagucaauuuucuaccgccugaaugguguuggcaucacacagcaaguguuaucugaaaaccagaagcucauugcaaauaaauuuaaccaggcgcugggggccaugcagaccggauucacuacaaccaaugaggcuuuucggaagguacaagacgccgugaacaacaaugcacaggcucuuagcaagcuggccagugaauuguccaacacuuucggcgcaaucagcgccucuauaggggauaucauucagagacucgacguccuggagcaggaugcucaaaucgacaggcuaauuaauggacgccugaccacacucaacgcguucguggcccagcagcugguucgaucagaguccgcagcucuuagugcccaguuggccaaagauaaggugaaugaaugcgucaaagcucaaagcaagcggucgggcuuuuguggucaggggacgcacaucgugucuuucguugugaacgcaccuaauggacuguauuuuaugcaugucggcuacuaucccuccaaccacauagagguagugagcgccuacgguuuaugcgacgcggcuaauccaaccaacuguauugcccccguuaauggcuacuucaucaaaacuaacaauacacguaucguggacgaauggucauauaccgggaguucuuuuuacuccccugagccaauuacaagccucaacacuaaguaugucgcaccccaggugaccuaccagaauaucucaacgaaccugccuccgccacuucugggaaacaguacaggcauugauuuccaagacgagcuagaugaauuuuucaagaauguaagcaccuccauacccaacuuugggucucucacucagaucaauaccacacuguuggaccugacuuaugagauguuaagccuccagcaaguggucaaagcccugaacgaauccuacauugaucuuaaggagcugggaaauuauaccuacuacaacaaauggccuugguauaucugguugggcuucauugcuggucucguugcacuggcccuaugcguguuuuucauccuguguugcacaggguguggaacgaauugcaugggcaaacuuaagugcaacagauguugcgacagguacgaagaguaugaucucgagccacauaaggugcacguccacuga

SEQ ID NO: 688 - RNA, 4062 nt, Artificial Sequence
  derived and/or modified CDS sequence (opt3) from MERS-CoV__AJG44080__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauaaagagcgauaggaaagccugggcagcuuucuauguguacaaacuucagccuuugaccuuucugcuagacuucucggucgauggcuauauccggcgcgccauugacugcggguuuaacgaucucucucagcugcauuguuccuacgagucauucgacguugaaaguggaguguauagcguauccucuuuugaggcgaagccaagcgguucaguggucgaacaagccgagggcguggagugcgauuucaguccccuucuguccgggacgccuccacagguuuacaacuuuaagcgauugguguucaccaauuguaacuacaaucucacaaagcuguuaagccuguucucugucaacgacuuuacuugcucacagaucagucccgcagcuauagccagcaauuguuauuccucucucauucuugauuacuucucguauccgcugagcaugaaauccgacuugucagugaguucugcuggaccuaucagccaauuuaacuacaagcaguccuucucaaauccaaccugccuaauccuggccacaguaccccacaaccucacuaccauuacaaaaccucugaaguauagcuacaucaauaaaugcucuagacuucuguccgaugacaggaccgaaguuccccaguuggugaacgcaaaucaguauaguccaugugucagcauugugcccucuacugucugggaggacggcgauuacuaccggaagcaacucuccccucuggaaggugggggcugguuaguggccucaggaaguacgguugcuaugacagagcagcugcagaugggcuuugggauaaccgugcaguauggaacugacaccaacagcguaugcccaaaacuagaguucgcgaaugauacaaagaucgcaucgcaacucgguaacugugucgaauacucccuguauggcgugucugggcguggaguuuuucagaauugcaccgccgugggcguccgccagcagagauucguguacgacgcuuaucaaaaccuuguagguuacuauagcgaugacgggaacuacuacuguuugagggccugcgugucaguuccggucagugugauuuaugauaaggagacuaaaacacaugcaacgcuguuuggcuccguggccugugaacacaucucuagcaccaugucccaguacucacggagcacucgaaguaugcucaagcgcagagacucuacauauggaccccugcagaccccugucggcugcguucuugggcugguaaauuccagcuuguucguggaggauuguaaacucccacugggacagucguuaugcgcucugcccgacacaccuucaccacuaacucccaggucugugcggagugucccgggugaaaugcgccucgccuccaucgcauuuaaccacccuauucaaguggaucagcugaauagcucuuacuucaaacuuagcauaccaaccaacuuuuccuucggcguuacgcaggaguauauccaaaccacaauucagaaggugacugucgacuguaagcaguacaucugcaauggguuccagaagugcgaacaauugcugagagaguauggacaguuuuguucaaaaauuaaccaggcgcuccauggcgcuaaucugaggcaggaugacagugugcguaacuuauucgccagcguuaagucuucccaaucaagucccaucauaccugguuuugggggcgacuucaaucugacccuuuuggagcccgugagcaucuccacaggaucucggucggcacgaagcgccauugaagaucuccuguuugacaaaguaacuaucgcugauccaggcuacaugcagggguacgacgauugcaugcagcagggaccugccucagcaagagaccuaauuugugcucaauaugucgccggcuacaaggugcugcccccacucauggaugugaacauggaggcggccuauaccuccagucugcuugguucuaucgcuggggucggauggacggcaggcuugagcuccuucgccgcuauaccguuugcccagucaauuuucuacaggcugaaugguguuggcaucacacagcaaguguuaucugaaaaccagaaacucauugcaaauaaguuuaaccaggcgcugggggccaugcagaccggauucacuacaaccaaugaggcuuuucgcaagguacaagacgccgugaacaacaaugcacaggcucuuagcaaacuggccagugaauuguccaacacuuucggcgcaaucagcgccucuauaggggauaucauucagcggcucgacguccuggagcaggaugcucaaaucgacagacuaauuaauggaaggcugaccacacucaacgcguucguggcccagcagcugguucgcucagaguccgcagcucuuagugcccaguuggccaaggauaaagugaaugaaugcgucaaggcucaaagcaaacgaucgggcuuuuguggucaggggacgcacaucgugucuuucguugugaacgcaccuaauggacuguauuuuaugcaugucggcuacuaucccuccaaccacauagagguagugagcgccuacgguuuaugcgacgcggcuaauccaaccaacuguauugcccccguuaauggcuacuucaucaagacuaacaauacacggaucguggacgaauggucauauaccgggaguucuuuuuacuccccugagccaauuacaagccucaacacuaaguaugucgcaccccaggugaccuaccagaauaucucaacgaaccugccuccgccacuucugggaaacaguacaggcauugauuuccaagacgagcuagaugaauuuuucaaaaauguaagcaccuccauacccaacuuugggucucucacucagaucaauaccacacuguuggaccugacuuaugagauguuaagccuccagcaaguggucaaggcccugaacgaauccuacauugaucuuaaagagcugggaaauuauaccuacuacaacaaguggccuugguauaucugguugggcuucauugcuggucucguugcacuggcccuaugcguguuuuucauccuguguugcacaggguguggaacgaauugcaugggcaaacuuaagugcaaccguuguugcgacagauacgaagaguaugaucucgagccacauaaagugcacguccacuga

SEQ ID NO: 689 - RNA, 4062 nt, Artificial Sequence
  derived and/or modified CDS sequence (opt3) from MERS-CoV__AJG44102__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaagccacaaccucacuaccauuacaaagccccugaaauauucuuacaucaauaagugcuccagacuucugagugaugacaggaccgaaguuccucaguuggugaacgcaaaucaauauagccccugugucucuauugugccauccacugucugggaggacggcgauuacuaccggaaacagcucucaccccuggaaggugggggcugguuaguggccaguggaagcacgguugcuaugacagagcagcugcagaugggcuuugggauaaccgugcaauauggaacugacaccaacucgguaugcccuaagcuagaguucgcgaaugauacaaaaaucgcaucccagcucgguaacugugucgaauacucucuguauggcgugagcgggcguggaguuuuucagaauugcaccgccgugggcguccgccagcaaagauucguguacgacgcuuaucagaaccuuguagguuacuauucagaugacgggaacuacuacuguuugagggccugcgugaguguuccagucuccgugauuuaugauaaggagacuaagacacaugcaacgcuguuuggcucuguggccugugaacacaucagcuccaccaucucacaguacagccggaguacucgaucuaugcucaaacgcagagacuccacauauggaccgcugcagacccccgucggcugcguucuugggcuggugaauagcucguuguucguggaggauuguaagcucccucugggacaaucauuaugcgcucugccagacacacccucuacucuaaccccuaggaguguacgguccgucccaggugaaaugcgccucgccagcauugcauuuaaccaccccauacagguggaucagcuuaauucuagcuacuucaaacuuuccaucccgacgaacuuuucauucggcguuacccaagaguauauucagacaacuauccagaaggugaccgucgacuguaaacaguacgugugcaauggguuccaaaagugcgaacaguugcugagagaguauggacaguuuuguaguaagauuaaccaggcgcuccauggcgcuaaucugaggcaagaugacagcguucguaacuuauucgccucugugaaauccucacagaguagcccuaucauaccagguuuugggggcgacuucaaucugacacuuuuggagcccguauccaucucuacuggaucgcggagcgcacgaucagccauugaagaucuccuguuugacaaggucaccaucgcugauccuggcuacaugcagggguacgacgauugcaugcagcaaggacccgccuccgcaagagaccuaauuugugcucaguauguggccggcuacaaagugcugccaccucucauggaugucaacauggaggcggccuauacgaguucucugcuugguagcaucgcugggguuggauggacagcaggcuuguccucauucgccgcuauacccuuugcccagucuauuuucuacaggcugaauggugugggcaucacccaacagguauuaagcgaaaaccagaagcucauugcaaauaaauuuaaccaggcgcugggggccaugcaaacuggauucacaaccacuaaugaggcuuuucgcaaggugcaggacgccgucaacaacaaugcacaggcucuuaguaagcuggccuccgaauugagcaacaccuucggcgcaaucucugccucaauaggggauaucauucagcggcucgacgugcuggagcaagaugcucagaucgacagacuaauuaauggaaggcugacaacgcucaacgcguucguugcccagcagcuggugcgcuccgagagugcagcucuuagcgcccaauuggccaaagauaaggucaaugaaugcgugaaagcucagucgaagcgaucuggcuuuuguggucaggggacccacaucguuuccuucguggucaacgcaccaaauggacuguauuuuaugcauguaggcuacuauccgagcaaccacauagaggugguuucagccuacgguuuaugcgacgcggcuaauccuacuaacuguauugcccccgugaauggcuacuucaucaaaacaaacaauacccggaucgucgacgaauggaguuauacagggucuuccuuuuacagcccagagcccauuacuucacucaacaccaaguauguggcaccucagguaacguaccaaaauaucaguacaaaccugccacccccucuucugggaaacagcaccggcauugauuuccaggacgagcuagaugaauuuuucaagaauguguccacuucuauaccgaacuuugggagccucacccagaucaauacaacucuguuggaccugaccuaugagauguuaucccuccaacaggucguuaaagcccugaacgaaucauacauugaucuuaaggagcugggaaauuauacauacuacaacaaauggccaugguauaucugguugggcuucauugcuggucucguggcacuggcccuaugcguguuuuucauccuguguugcacgggguguggaaccaauugcaugggcaagcugaaaugcaaccguuguugcgacagauacgaagaguaugaucucgagccccauaagguccacgugcacuga

SEQ ID NO: 690 - RNA, 4062 nt, Artificial Sequence
  derived and/or modified CDS sequence (opt3) from MERS-CoV__AJG44124__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaguucgcgaaugauacaaaaaucgcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaagacacaugcaacgcuguuuggcuccguggccugugaacacaucucuagcaccauguuccaguacucccggucaacucgaagcaugcucaaacgcagagacaguacauauggaccccugcagaccccugucggcugcguucuugggcuggugaauagcuccuuguuuguggaggauuguaagcucccacugggacaaucuuuaugcgcucugcccgacacaccuucgacucuaaccccaaggucaguacggucuguccccggugaaaugcgccucgccaguaucgcauucaaccacccgauucagguggaucagcuuaauuccagcuacuuuaaacuuucuauaccuacgaacuucagcuucggcguuacccaagaguauauccagacaacuauucagaaggugaccgucgacuguaaacaguacgugugcaauggguuucaaaagugcgaacaguugcugagagaguauggacaguucuguuccaagaucaaccaggcgcuccauggcgcuaaucugaggcaagaugacucaguucguaacuuauuugccagugugaaaagcucucaguccucaccaauuauccccgguuucgggggcgacuuuaaucugacacuuuuggagccuguaaguauaagcacuggaucccggucugcacgaucggccaucgaagaucuccuguucgacaaggucaccauugcugaucccggcuacaugcagggguacgacgauugcaugcagcaaggaccagccagcgcaagagaccuaaucugugcucaguauguggccggcuacaaagugcugccuccccucauggaugucaacauggaggcggccuauacgucaucccugcuugguaguauugcugggguuggauggacagcaggcuugucuagcuuugccgcuaucccauucgcccaguccauauuuuacaggcugaauggugugggcauuacccaacagguauuaucagaaaaccagaagcucaucgcaaauaaauucaaccaggcgcugggggccaugcaaacuggauuuacaaccacuaaugaggcuuuccgcaaggugcaggacgccgucaacaacaaugcacaggcucuuucuaagcuggccagcgaauugaguaacaccuucggcgcaauuuccgccagcaucggggauauaauccagcggcucgacgugcuggagcaagaugcucagauugacagacuaaucaauggaaggcugacaacgcucaacgcguuuguugcccagcagcuggugcgcucugagucagcagcucuuuccgcccaauuggccaaagauaaggucaaugaaugcgugaaagcucagaguaagcgaagcggcuucuguggucaggggacccacauuguuucguuuguggucaacgcaccgaauggacuguauuucaugcauguaggcuacuauccuucuaaccacaucgaggugguuuccgccuacgguuuaugcgacgcggcuaaucccacuaacuguauagccccagugaauggcuacuuuauuaaaacaaacaauacccggaucgucgacgaauggagcuauacagggucaaguuucuacucucccgagccuaucacuucccucaacaccaaguauguggcaccacagguaacguaccaaaauauuagcacaaaccugcccccuccgcuucugggaaacucaaccggcaucgauuuucaggacgagcuagaugaguucuuuaagaaugugaguacuagcauuccaaacuucgggucccucacccagauaaauacaacucuguuggaccugaccuaugaaauguuaucucuccaacaggucguuaaagcccugaacgaaagcuacaucgaucuuaaggagcugggaaauuauacauacuacaacaaauggcccugguauauuugguugggcuuuaucgcuggucucguggcacuggcccuaugcguguucuuuauucuguguugcacgggguguggaaccaauugcaugggcaagcugaaaugcaaccguuguugcgacagauacgaagaguaugaucucgagccucauaagguccacgugcacuga

SEQ ID NO: 691 - RNA, 4062 nt, Artificial Sequence
  derived and/or modified CDS sequence (opt3) from MERS-CoV__ALL26396__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaguucgcgaaugauacaaaaaucgcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaagacacaugcaacgcuguuuggcuccguggccugugaacacaucucuagcaccaugucccaguacucacggagcacucgaaguaugcucaaacgcagagacucuacauauggaccccugcagaccccugucggcugcguucuugggcugguaaauuccagcuugucgguggaggauuguaagcucccacugggacaaucauuaugcgcucugcccgacacaccuucuacucuaaccccaaggagugugcgguccguccccggugaaaugcgccucgccagcaucgcauucaaccacccgauucagguggaucagcuuaauucuagcuacuuuaaacuuuccauaccuacgaacuucucauuuggcguuacccaagaguauauccagacaacuauucagaaggugaccgucgacuguaaacaguacgugugcaauggguuccaaaagugcgaacaguugcugagagaguauggacaguucuguaguaagaucaaccaggcgcuccauggcgcuaaucugaggcaagaugacagcguucguaacuuauuugccucugugaaauccucacagaguagcccaauuauccccgguuucgggggcgacuuuaaucugacacuuuuggagccuguauccauaucuacuggaucgcggagcgcacgaucagccaucgaagaucuccuguucgacaaggucaccauugcugaucccggcuacaugcagggguacgacgauugcaugcagcaaggaccagccuccgcaagagaccuaaucugugcucaguauguggccggcuacaaagugcugccuccccucauggaugucaacauggaggcggccuauacgaguucucugcuugguagcauugcugggguuggauggacagcaggcuuguccucauuugccgcuaucccauucgcccagucuauauuuuacaggcugaauggugugggcauuacccaacagguauuaagcgaaaaccagaagcucaucgcaaauaaauucaaccaggcgcugggggccaugcaaacuggauuuacaaccacuaaugaggcuuuccgcaaggugcaggacgccgucaacaacaaugcacaggcucuuaguaagcuggccuccgaauugagcaacaccuuuggcgcaauuucugccucaaucggggauauaauccagcggcucgacgugcuggagcaagaugcucagauugacagacuaaucaauggaaggcugacaacgcucaacgcguucguugcccagcagcuggugcgcuccgagagugcagcucuuagcgcccaauuggccaaagauaaggucaaugaaugcgugaaagcucagucgaagcgaucuggcuucuguggucaggggacccacauuguuuccuuuguggucaacgcaccgaauggacuguauuucaugcauguaggcuacuauccuagcaaccacaucgaggugguuucagccuacgguuuaugcgacgcggcuaaucccacuaacuguauagccccagugaauggcuacuuuauuaaaacaaacaauacccggaucgucgacgaauggaguuauacagggucuuccuucuacgcacccgagccuaucacuagccucaacaccaaguauguggccccacagguaacguaccaaaauauuucaacaaaccugcccccuccgcuucugaguaacagcaccggaaucgauuuucaggacgagcuagaugaguucuuuaagaauguguccacuucuauuccaaacuucggcagccucacccagauaaauacaacucuguuggaccugaccuaugaaauguuaucccuccaacaggucguuaaagcucugaacgaaucauacaucgaucuuaaggagcuggggaauuauacauacuacaacaaauggcccugguauauuugguugggauuuaucgcaggccucguggcccuggcgcuaugcguguucuuuauucuguguugcacggguugugggaccaauugcaugggaaagcugaaaugcaaccguuguugcgacagauacgaagaguaugaucucgagccucauaagguccacgugcacuga

SEQ ID NO: 692 - RNA, 4062 nt, Artificial Sequence
  derived and/or modified CDS sequence (opt3) from MERS-CoV__ALS20350__S
augauccacagcguguuccugcucauguuucuucugacccccacagaguccuacgucgacguuggcccugauucugccaagucagcuugcauugaaguggacauacagcaaacuuucuuugauaaaacguggccaagaccgaucgacguaaguaaggcagaugggauuaucuauccccagggaaggaccuacagcaacauuacaaucacuuaucaggguuuguucccuuaccagggcgaccauggggauauguauguguacuccgccggacacgcgaccggcacaaccccacaaaaauuauuugucgcuaauuauucucaggacgugaagcaguucgccaacgguuuuguugugcggauaggggcagccgcuaauucgacuggaacagucaucauuucacccagcaccagugcaacgauccgcaaaauuuacccugccuucaugcugggcuccucugugggcaacuuuagcgaugggaagaugggacgauucuuuaaucauacucuaguacuccugccagacgguuguggcacccuucugcgugcuuucuacugcaucuuggagcccagauccgggaacuauuguccugccggaaauucauacacaaguuuugcgacuuaucacaccccagcaacagauugcagcgacggcaacuacaauaggaacgccucucucaauuccuucaaggaauauuucaaccugcggaauuguaccuuuauguacacguauaacauaacugaggaugaaauucuggagugguucgguaucacacagaccgcucaagggguucaucucuuuucaagccgcuacguggacuuauacggaggcaauauguuccaguuugccacucugccggucuaugacacaauuaaauacuauaguaucaucccccacucuauuagauccauacagagcgauaggaaggcaugggcugccuucuacguguauaaacuucagccuuugaccuuucugcuagacuucucgguggauggcuacauccggcgcgcgauugacugcggguuuaacgaucucucucaacugcacuguuccuaugagucauucgacgucgaaaguggaguuuacagcguguccucuuuugaggccaagccaagcgguucaguaguggaacaggcagagggcgucgagugcgauuucaguccccuucuguccgggacgccuccacagguguacaacuuuaaacgauugguuuucaccaauuguaacuauaaucucacaaagcuguuaagccuguucucugugaacgacuuuacuugcucacaaaucagucccgcugccauagcuagcaauuguuacuccucucucauucuugauuauuucucguacccgcugagcaugaaguccgacuugucagucaguucugccggaccuaucagccaguuuaacuauaaacaguccuucucaaauccaaccugccuaauccuggcaacagugccccauaaccucacuaccauuacaaagccucugaaauacagcuauaucaauaagugcucuagacuucuguccgaugacaggaccgaaguaccccaguugguuaacgccaaucaauacaguccaugugugagcauuguccccucuacugugugggaggacggcgauuacuaucggaaacagcucuccccucuggaaggugggggcugguuagucgcuucaggaaguacgguggcgaugacagagcagcugcagaugggcuuugggauaaccguucaauacggaacugacaccaacagcgugugcccaaagcuagaguucgcaaaugauacaaaaaucgccucgcagcucgguaacuguguagaauauucccuguacggcgucucugggcguggaguguuucagaauugcaccgcuguuggcgugcgccagcaaagauucgucuaugacgccuaccagaaccuuguggguuauuacagcgaugacgggaacuacuauuguuugagggcaugcguaacugugccgguuucagucauuuacgauaaggagacaaagacgcacgccacccuguuuggcaguguggcuugugaacauaucuccucuacuaugagccaguauucccggucaacacgaagcaugcucaaacgcagagacaguaccuacggaccccugcagacaccugugggcugcguccuugggcugguuaauucuuccuuguucguggaggauuguaagcucccacugggacaaagccugugcgcccugcccgacacuccuucgacccuaacgccaaggucagugcggucuguacccggugaaaugcgccucgcaaguaucgcguuuaaccacccgauucaggucgaucaguuaaauuccagcuauuucaaacuuucuauaccuaccaacuuuagcuucggcgugacacaagaguacauccagacuaccauucagaagguuacaguggacuguaaacaguaugucugcaauggguuccaaaagugcgaacaguugcugagagaguacggacaguuuuguuccaagaucaaccaggcucuccacggcgccaaucugaggcaagaugacucagugcguaacuuauucgcaaguguuaaaagcuaccagucuuccccaauuauccccgguuuugggggcgacuucaaucugacucuuuuggagccugugucaauaaguaccggaagccgguccgcccgaucugcuaucgaagaucuccuguuugacaagguaacgauugccgaucccggcuauaugcagggguacgacgauugcaugcaucagggaccagcaucggcuagagaccuaaucugugcccaauaugucgcgggcuacaaagugcugccuccccucauggaugugaacauggaggccgcuuauacaagcucacugcuugguuccauugcaggggucggauggaccgccggcuugaguucuuucgcugccaucccauuugcacagagcauauucuacaggcugaaugguguuggcauuacucagcaaguguuauccgaaaaccagaagcucaucgcgaauaaauuuaaccaggcccugggggcuaugcagacaggauucaccacuaccaaugaggccuuucaaaagguacaggacgcagugaacaacaaugcucaggcccuuucaaagcuggcaucugaauugagcaacacauucggcgccauuagugcuuccaucggggauauaauccagcgccucgacguccuggagcaagaugcgcagauugaccggcuaaucaauggaagacugacgacccucaacgccuucguggcacagcagcugguuaggagcgagucugcugcccuuucagcccaauuggcuaaagauaaggugaaugaaugcgucaaagcacaguccaagcgcaguggcuuuuguggucaggggacucacauugugagcuucguugugaacgccccgaauggacuguauuuuaugcaugucggcuacuacccuucgaaccacaucgagguagugucugcguaugguuuaugcgaccucgcuaaucccacaaacuguauagccccaguuaauggcuacuucauuaaaaccaacaauacacgaaucguggacgaaugguccuauacugggagcucauuuuacgcacccgagccuaucaccaguuucaacacgaaguaugucgccccacaggugacauaccaaaauauuucuaccaaccugcccccuccgcuucugggaaacuccacuggcaucgauuuucaggacgagcuagaugaguucuuuaagaauguaagcaccucaauuccaaacuucgggagucucacacagauaaauacuacccuguuggaccugacauaugaaauguuaagccuccaacagguggucaaagcucugaacgaauccuacaucgaucuuaaggagcugggaaauuacacguauuacaacaaauggcccugguauauuugguugggcuuuaucgcaggucucguugcccuggcgcuaugcguguucuuuauucuguguugcaccggguguggaacuaauugcaugggcaaacuuaagugcaaccgguguugcgaccguuacgaagaguaugaucucgagccucauaaggugcacguccacuga

SEQ ID NO: 693 - RNA, 4062 nt, Artificial Sequence
  derived and/or modified CDS sequence (opt3) from MERS-CoV__ALT66880__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaguucgcgaaugauacaaaaaucgcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaagacacaugcaacgcuguuuggcuccguggccugugaacacaucucuagcaccaugucccaguacucacggagcacucgaaguaugcucaaacgcagagacucuacauauggaccccugcagaccccugucggcugcguucuugggcugguaaauuccagcuuguucguggaggauuguaagcucccacugggacaaucguuaugcgcucugcccgacacaccuucaacucuaaccccaaggucugugcggaguguccccggugaaaugcgccucgccuccaucgcauuuaaccacccgauucagguggaucagcugaauagcucuuacuucaaacuuagcauaccuacgaacuuuuccuucggcguuacccaagaguauauccagacaacuauucagaaggugaccgucgacuguaaacaguacgugugcaauggguuccaaaagugcgaacaguugcugagagaguauggacaguuuuguucaaagaucaaccaggcgcuccauggcgcuaaucugaggcaagaugacaguguucguaacuuauucgccagcgugaaaucuucccagucaaguccaauuauccccgguuuugggggcgacuucaaucugacacuuuuggagccuguaagcauauccacuggaucucggucggcacgaagcgccaucgaagaucuccuguuugacaaggucaccauugcugaucccggcuacaugcagggguacgacgauugcaugcagcaaggaccagccucagcaagagaccuaaucugugcucaguauguggccggcuacaaagugcugccuccccucauggaugucaacauggaggcggccuauacguccagucugcuugguucuauugcugggguuggauggacagcaggcuugagcuccuucgccgcuaucccauuugcccagucaauauucuacaggcugaauggugugggcauuacccaacagguauuaucugaaaaccagaagcucaucgcaaauaaauuuaaccaggcgcugggggccaugcaaacuggauucacaaccacuaaugaggcuuuucgcaaggugcaggacgccgucaacaacaaugcacaggcucuuagcaagcuggccagugaauuguccaacaccuucggcgcaauuagcgccucuaucggggauauaauccagcggcucgacgugcuggagcaagaugcucagauugacagacuaaucaauggaaggcugacaacgcucaacgcguucguugcccagcagcuggugcgcucagaguccgcagcucuuagugcccaauuggccaaagauaaggucaaugaaugcgugaaagcucagagcaagcgaucgggcuuuuguggucaggggacccacauuguuucuuucguggucaacgcaccgaauggacuguauuuuaugcauguaggcuacuauccuuccaaccacaucgaggugguuagcgccuacgguuuaugcgacgcggcuaaucccacuaacuguauagccccagugaauggcuacuucauuaaaacaaacaauacccggaucgucgacgaauggucauauacagggaguucuuuuuacucccccgagccuaucacuagccucaacaccaaguauguggcaccacagguaacguaccaaaauauuucaacaaaccugcccccuccgcuucugggaaacaguaccggcaucgauuuccaggacgagcuagaugaauuuuucaagaaugugagcacuuccauuccaaacuuugggucucucacccagauaaauacaacucuguuggaccugaccuaugagauguuaagccuccaacaggucguuaaagcccugaacgaauccuacaucgaucuuaaggagcugggaaauuauacauacuacaacaaauggcccugguauauuugguugggcuucaucgcuggucucguggcacuggcccuaugcguguuuuucauucuguguugcacgggguguggaaccaauugcaugggcaaacuuaagugcaaccguuguugcgacagauacgaagaguaugaucucgagccucauaagguccacgugcacuga

SEQ ID NO: 694 - RNA, 4062 nt, Artificial Sequence
  derived and/or modified CDS sequence (opt3) from MERS-CoV__ALA49341__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccuuacaaaaacuguuuguggcgaauuauucucaggacguuaagcaguucgcuaacgguuuugugguccggauaggggccgcagccaauucgacuggaacagugaucauuucaccaagcaccagugcuacgauccgcaaaauuuaccccgcauucaugcuaggcuccucuguaggcaacuuuagcgaugggaagaugggacgauucuuuaaucauacucucguucugcuuccugacgguuguggcacccuguugcgugccuucuacugcauccucgagccaagauccgggaaccacugucccgcuggaaauucauauacaaguuuugccacuuaccauaccccugcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcacuuauuuucaagccgcuaugucgaccuguacggaggcaauauguuccaguuugcuacucuuccaguguacgacacaauuaaauauuacaguaucaucccgcacucuauuagauccauacagagcgauaggaaggccugggcagcuuucuauguguacaaauugcagccccugaccuuucuacucgacuucucggucgauggcuauauccggcgcgccauugacugcggguuuaacgaucugucucaacuucauuguuccuacgagucauucgacguugaaaguggaguguauagcguauccucuuuugaggcgaagccuagcgguucaguggucgaacaggccgagggcguggagugcgauuucaguccacuguuguccgggacgcccccucagguuuacaacuuuaaacgacucguguucaccaauuguaacuacaaucugacaaaguuacugagccucuucucugucaacgacuuuaucugcucacaaauaaguccagcagcuauugccagcaauuguuauuccucucuuauccuggauuacuucucguaucccuugagcaugaaguccgaccuaucagugaguucugcuggaccgaucagccaguuuaacuacaaacaguccuucucaaauccuacuugccugauucucgccaccguaccccacaaccugacaacuaucaccaagccacuuaaauauagcuacauuaauaagugcucuagacuguuguccgaugacaggacagaaguuccucagcucgugaacgcaaaucaauauagucccugugucagcauagugccaucuaccgucugggaggacggcgauuacuaccggaaacagcugucccccuuagaaggugggggcuggcugguggccucaggaaguacuguugcuaugacggagcagcuacagaugggcuuugggaucacagugcaauauggaaccgacacuaacagcguaugcccuaagcucgaguucgcgaaugauaccaaaauugcaucgcagcuggguaacugugucgaauacucccuuuauggcgugucugggcguggaguuuuucagaauugcacagccgugggcguccgccagcaaagauucguguacgacgcuuaucagaacuugguagguuacuauagcgaugacgggaacuacuacugucugagggccugcgugucaguuccagucagugugaucuaugauaaggagaccaagacucaugcaacacucuuuggcuccguggccugugaacacaucucuagcacgaugucccaguacucacggagcacccgaaguaugcugaaacgcagagacucuacuuauggaccgcuucagacacccgucggcugcguucugggguugguaaauuccagccucuucguggaggauuguaagcugccuuuaggacaaucgcugugcgcucuaccagacacccccucaacacucacuccuaggucugugcggagugucccaggugaaaugcgccuggccuccauugcauuuaaccaccccauacagguggaucagcuuaauagcucuuacuucaaauugagcaucccgaccaacuuuuccuucggcguuacgcaagaguauauucagaccacaauccagaaggugacugucgacuguaaacaguacgugugcaauggguuccaaaagugcgaacagcugcucagagaguauggacaguuuuguucaaagauuaaccaggcgcugcauggcgcuaauuuaaggcaagaugacaguguucguaaccuguucgccagcgugaaaucuucccagucaaguccuaucauaccagguuuugggggcgacuucaaucuuaccuugcucgagcccguaagcaucuccacaggaucucggucggcacgaagcgccauugaagaucugcuauuugacaaggucacuaucgcugauccuggcuacaugcagggguacgacgauugcaugcagcaaggacccgccucagcaagagaccugauuugugcucaguauguggccggcuacaaagugcucccaccucugauggaugucaacauggaggcggccuauaccuccagucuuuuggguucuaucgcugggguuggauggacggcaggccugagcuccuucgccgcuauacccuuugcccagucaauuuucuacagguuaaauggugugggcaucacacaacagguacucucugaaaaccagaagcugauugcaaauaaauuuaaccaggcgcuuggggccaugcaaaccggauucacuacaaccaaugaggcuuuucgcaaggugcaggacgccgucaacaacaaugcacaggcucugagcaaguuggccagugaacucuccaacacuuucggcgcaaucagcgccucuauaggggauaucauucagcggcuggacgugcuagagcaagaugcucagaucgacagacugauuaauggaaggcucaccacacugaacgcguucguugcccagcagcuugugcgcucagaguccgcagcuuugagugcccaacuggccaaagauaaggucaaugaaugcgugaaagcucagagcaagcgaucgggcuuuuguggucaggggacgcacaucguuucuuucguggucaacgcaccaaauggauuauauuuuaugcauguaggcuacuauccguccaaccacauagaggugguuagcgccuacggucucugcgacgcggcuaauccuaccaacuguauugcccccgugaauggcuacuucaucaaaacuaacaauacacggaucgucgacgaauggucauauaccgggaguucuuuuuacgcaccagagcccauuacaucccugaacacuaaguauguggccccucagguaaccuaccaaaauaucagcacgaaccuuccacccccucugcuaggaaacucaacaggcauugauuuccaggacgagcucgaugaauuuuucaagaaugugaguaccagcauaccgaacuuugggucccugacucagaucaauaccacauugcuggacuuaacuuaugagaugcucucucugcaacaggucguuaaagcucuuaacgaaagcuacauugaucugaaggaguugggaaauuauaccuacuacaacaaauggccaugguauaucuggcucggcuucauugcaggucugguggcccuagcgcugugcguguuuuucauccuuuguugcacaggguguggaacgaauugcaugggcaagcucaaaugcaaccguuguugcgacagauacgaagaguaugaucuggagccccauaagguccacgugcacuga

SEQ ID NO: 695 - RNA, 4062 nt, Artificial Sequence
  derived and/or modified CDS sequence (opt3) from MERS-CoV__ALA49352__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuacuauaccccagcgacagauugcagcgacggcaacuacaauaggaacgcaucucucaauuccuucaaggaauauuucaaccugcggaauuguaccuuuauguacacguauaacauaacugaggaugaaauucuggagugguucgguaucacacagaccgcccaaggggugcaucucuuuucaagccgcuacgucgacuuauacggaggcaauauguuccaguuugcuacucugccgguguaugacacaauuaaauacuauaguaucaucccccacucuauuagauccauacagagcgauaggaaggccugggcagcuuucuacguguauaaacuucagccuuugaccuuucugcuagacuucucggucgauggcuacauccggcgcgccauugacugcggguuuaacgaucucucucaacugcacuguuccuaugagucauucgacguugaaaguggaguguacagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuauaaucucacaaagcuguuaagccuguucucugucaacgacuuuacuugcucacaaaucagucccgcagcuauagccagcaauuguuacuccucucucauucuugauuauuucucguacccgcugagcaugaaguccgacuugucagugaguucugcuggaccuaucagccaguuuaacuauaaacaguccuucucaaauccaaccugccuaauccuggccacaguaccccauaaccucacuaccauuacaaagccucugaaauacagcuauaucaauaagugcucuagacuucuguccgaugacaggaccgaaguuccccaguuggugaacgcaaaucaauacaguccaugugucagcauugugcccucuacugucugggaggacggcgauuacuaucggaaacagcucuccccucuggaaggugggggcugguuaguggccucaggaaguacgguugcuaugacagagcagcugcagaugggcuuugggauaaccgugcaauacggaacugacaccaacagcguaugcccaaagcuagaguucgcgaaugauacaaaaaucgcaucgcagcucgguaacugugucgaauauucccuguacggcgugucugggcguggaguuuuucagaauugcaccgccgugggcguccgccagcaaagauucguguaugacgcuuaccagaaccuuguagguuauuacagcgaugacgggaacuacuauuguuugagggccugcgugucaguuccggucagugugauuuacgauaaggagacuaagacacacgcaacgcuguuuggcuccguggccugugaacauaucucuagcaccaugucccaguauucacggagcacucgaaguaugcucaaacgcagagacucuacauacggaccccugcagaccccugucggcugcguucuugggcugguaaauuccagcuuguucguggaggauuguaagcucccacugggacaaucguuaugcgcucugcccgacacaccuucaacucuaaccccaaggucugugcggaguguccccggugaaaugcgccucgccuccaucgcauuuaaccacccgauucagguggaucagcugaauagcucuuauuucaaacuuagcauaccuacgaacuuuuccuucggcguuacccaagaguacauccagacaacuauucagaaggugaccgucgacuguaaacaguaugugugcaauggguuccaaaagugcgaacaguugcugagagaguacggacaguuuuguucaaagaucaaccaggcgcuccacggcgcuaaucugaggcaagaugacaguguucguaacuuauucgccagcgugaaaucuucccagucaaguccaauuauccccgguuuugggggcgacuucaaucugacacuuuuggagccuguaagcauauccacuggaucucggucggcacgaagcgccaucgaagaucuccuguuugacaaggucaccauugcugaucccggcuacaugcagggguaugacgauugcaugcagcaaggaccagccucagcaagagaccuaaucugugcucaguacguggccggcuauaaagugcugccuccccucauggaugucaacauggaggcggccuacacguccagucugcuugguucuauugcugggguuggauggacagcaggcuugagcuccuucgccgcuaucccauuugcccagucaauauucuauaggcugaauggugugggcauuacccaacagguauuaucugaaaaccagaagcucaucgcaaauaaauuuaaccaggcgcugggggccaugcaaacuggauucacaaccacuaaugaggcuuuucgcaaggugcaggacgccgucaacaacaaugcacaggcucuuagcaagcuggccagugaauuguccaacaccuucggcgcaauuagcgccucuaucggggauauaauccagcggcucgacgugcuggagcaagaugcucagauugacagacuaaucaauggaaggcugacaacgcucaacgcguucguugcccagcagcuggugcgcucagaguccgcagcucuuagugcccaauuggccaaagauaaggucaaugaaugcgugaaagcucagagcaagcgaucgggcuuuuguggucaggggacccauauuguuucuuucguggucaacgcaccgaauggacuguacuuuaugcacguaggcuauuacccuuccaaccauaucgaggugguuagcgccuacgguuuaugcgacgcggcuaaucccacuaacuguauagccccagugaauggcuauuucauuaaaacaaacaauacccggaucgucgacgaauggucauacacagggaguucuuuuuaugcacccgagccuaucacuucccucaacaccaaguacguggccccacagguaacguaucaaaauauuagcacaaaccugcccccuccgcuucugggaaacucaaccggcaucgauuuccaggacgagcuagaugaauuuuucaagaaugugaguacuagcauuccaaacuuugggucccucacccagauaaauacaacucuguuggaccugaccuacgagauguuaucucuccaacaggucguuaaagcucugaacgaaagcuauaucgaucuuaaggagcugggaaauuacacauacuauaacaaauggcccugguacauuugguugggcuucaucgcaggucucguggcccuggcgcuaugcguguuuuucauucuguguugcacgggguguggaaccaauugcaugggcaaacuuaagugcaaccguuguugcgacagauaugaagaguacgaucucgagccucacaagguccaugugcacuga

SEQ ID NO: 696 - RNA, 4062 nt, Artificial Sequence
  derived and/or modified CDS sequence (opt3) from MERS-CoV__ALA49363__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacuuucccgguguacgacacaauuaaauauuacaguaucaucccccacucuauuagauccauacagagcgauaggaaggccugggcagcuuuuuauguguacaaacugcagccucuuaccuucuugcuggacuuuucggucgauggcuauauccggcgcgccauugacugcggguucaacgaucuaucucaacuccauuguuccuacgagucauuugacguugaaaguggaguguauagcguauccucuuucgaggcgaagccaagcgguucaguggucgaacaggccgagggcguggagugcgauuuuaguccccugcuuuccgggacgccuccacagguuuacaacuucaaacgacugguguucaccaauuguaacuacaauuugacaaagcuccugagcuuauuuucugucaacgacuucacuugcucacaaaucagucccgcagcuauagccagcaauuguuauuccucucugauucucgauuacuuuucguauccgcuuagcaugaaguccgaccugucagugaguucugcuggaccuaucagccaguucaacuacaaacaguccuuuucaaauccaaccugcuugauccuagccacaguaccccacaaccugacuaccauuacaaagccucucaaauauagcuacaucaauaagugcucuagacugcuuuccgaugacaggaccgaaguuccccagcuggugaacgcaaaucaauauaguccaugugucagcauugugcccucuacugucugggaggacggcgauuacuaccggaaacaguuguccccucucgaaggugggggcuggcugguggccucaggaaguacgguugcuaugacagagcaguuacagaugggcuucgggauaaccgugcaauauggaacugacaccaacagcguaugcccaaagcuggaauuugcgaaugauacaaaaaucgcaucgcagcuagguaacugugucgaguacucccucuauggcgugucugggcguggaguuuuccagaauugcaccgccgugggcguccgccagcaaagauuuguguacgacgcuuaucagaaccugguagguuacuauagcgaugacgggaacuacuacugucuuagggccugcgugucaguuccggucagugugauuuaugauaaggagacuaagacacaugcaacguuguucggcuccguggccugugaacacaucucuagcaccaugucccaguacucacggagcacucgaaguaugcugaaacgcagagacucuacauauggaccccuccagaccccugucggcugcguucuggggcuuguaaauuccagccuguuuguggaggauuguaaguugccacucggacaaucgcugugcgcuuuacccgacacaccuucaacucugaccccaaggucugugcggaguguccccggugaaaugcgccuagccuccaucgcauucaaccacccgauucagguggaucagcucaauagcucuuacuuuaaacugagcauaccuacgaacuucuccuucggcguuacccaagaguauauccagacaacuauucagaaggugaccgucgacuguaaacaguacgugugcaauggguuucaaaagugcgaacagcuuuugagagaguauggacaguucuguucaaagaucaaccaggcgcugcauggcgcuaaucucaggcaagaugacaguguucguaaccuguuugccagcgugaaaucuucccagucaaguccaauuauccccgguuucgggggcgacuuuaauuuaacacugcuugagccuguaagcauauccacuggaucucggucggcacgaagcgccaucgaagaucuccucuucgacaaggucaccauugcugaucccggcuacaugcagggguacgacgauugcaugcagcaaggaccagccucagcaagagaccugaucugugcucaguauguggccggcuacaaagugcuaccuccccugauggaugucaacauggaggcggccuauacguccagucuccuggguucuauugcugggguuggauggacagcaggccuuagcuccuuugccgcuaucccauucgcccagucaauauuuuacagguugaauggugugggcauuacccaacagguacugucugaaaaccagaaguuaaucgcaaauaaauucaaccaggcgcucggggccaugcaaacuggauuuacaaccacuaaugaggcuuuccgcaaggugcaggacgccgucaacaacaaugcacaggcucugagcaaacuugccagugaacuguccaacaccuucggcgcaauuagcgccucuaucggggauauaauccagcgguuggacgugcucgagcaagaugcucagauugacagacugaucaauggaaggcuaacaacgcugaacgcguuuguugcccagcagcucgugcgcucagaguccgcagcucugagugcccaacuugccaaggauaaggucaaugaaugcgugaaagcucagagcaagcgaucgggcuucuguggucaggggacccacauuguuucuuuuguggucaacgcaccgaauggauuguauuucaugcauguaggcuacuauccuuccaaccacaucgaggugguuagcgccuacggucugugcgacgcggcuaaucccacuaacuguauagccccagugaauggcuacuuuauuaaaacaaacaauacccggaucgucgacgaauggucauauacagggaguucuuucuacgcacccgagccuaucacuuccuuaaacaccaaguauguggccccacagguaacguaccaaaauauuagcacaaacuugcccccuccgcugcuuggaaacucaaccggcaucgauuuucaggacgagcuggaugaguucuuuaagaaugugaguacuagcauuccaaacuucgggucccuaacccagauaaauacaacucuccuggacuugaccuaugaaaugcugucuuuacaacaggucguuaaagcucucaacgaaagcuacaucgaucugaaggagcuuggaaauuauacauacuacaacaaauggcccugguauauuuggcugggcuuuaucgcagguuugguggcccucgcgcugugcguguucuuuauucuauguugcacgggguguggaaccaauugcaugggcaagcugaaaugcaaccguuguugcgacagauacgaagaguaugaucuugagccucauaagguccacgugcacuga

SEQ ID NO: 697 - RNA, 4062 nt, Artificial Sequence
  derived and/or modified CDS sequence (opt3) from MERS-CoV__ALA49374__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaauuucacaaagcuccugagcuuauuuucugucaacgacuucacuugcucacaaaucagucccgcagcuauagccagcaauuguuauuccucucugauucucgauuacuuuucguauccgcuuagcaugaaguccgaccugucagugaguucugcuggaccuaucagccaguucaacuacaaacaguccuuuucaaauccaaccugcuugauccuagccacaguaccccacaaccugacuaccauuacaaagccucucaaauauagcuacaucaauaagugcucuagacugcuuuccgaugacaggaccgaaguuccccagcuggugaacgcaaaucaauauaguccaugugucagcauugugcccucuacugucugggaggacggcgauuacuaccggaaacaguuguccccucucgaaggugggggcuggcugguggccucaggaaguacgguugcuaugacagagcaguuacagaugggcuucgggauaaccgugcaauauggaacugacaccaacagcguaugcccaaagcuggaauuugcgaaugauacaaaaaucgcaucgcagcuagguaacugugucgaguacucccucuauggcgugucugggcguggaguuuuccagaauugcaccgccgugggcguccgccagcaaagauuuguguacgacgcuuaucagaaccugguagguuacuauagcgaugacgggaacuacuacugucuuagggccugcgugucaguuccggucagugugauuuaugauaaggagacuaagacacaugcaacguuguucggcuccguggccugugaacacaucucuagcaccaugucccaguacucacggagcacucgaaguaugcugaaacgcagagacucuacauauggaccccuccagaccccugucggcugcguucuggggcuuguaaauuccagccuguuuguggaggauuguaaguugccacucggacaaucgcugugcgcuuuacccgacacaccuucaacucugaccccaaggucugugcggaguguccccggugaaaugcgccuagccuccaucgcauucaaccacccgauucagguggaucagcucaauagcucuuacuuuaaacugagcauaccuacgaacuucuccuucggcguuacccaagaguauauccagacaacuauucagaaggugaccgucgacuguaaacaguacgugugcaauggguuucaaaagugcgaacagcuuuugagagaguauggacaguucuguucaaagaucaaccaggcgcugcauggcgcuaaucucaggcaagaugacaguguucguaaccuguuugccagcgugaaaucuucccagucaaguccaauuauccccgguuucgggggcgacuuuaauuuaacacugcuugagccuguaagcauauccacuggaucucggucggcacgaagcgccaucgaagaucuccucuucgacaaggucaccauugcugaucccggcuacaugcagggguacgacgauugcaugcagcaaggaccagccucagcaagagaccugaucugugcucaguauguggccggcuacaaagugcuaccuccccugauggaugucaacauggaggcggccuauacguccagucuccuggguucuauugcugggguuggauggacagcaggccuuagcuccuuugccgcuaucccauucgcccagucaauauuuuacagguugaauggugugggcauuacccaacagguacugucugaaaaccagaaguuaaucgcaaauaaauucaaccaggcgcucggggccaugcaaacuggauuuacaaccacuaaugaggcuuuccgcaaggugcaggacgccgucaacaacaaugcacaggcucugagcaaacuugccagugaacuguccaacaccuucggcgcaauuagcgccucuaucggggauauaauccagcgguuggacgugcucgagcaagaugcucagauugacagacugaucaauggaaggcuaacaacgcugaacgcguuuguugcccagcagcucgugcgcucagaguccgcagcucugagugcccaacuugccaaggauaaggucaaugaaugcgugaaagcucagagcaagcgaucgggcuucuguggucaggggacccacauuguuucuuuuguggucaacgcaccgaauggauuguauuucaugcauguaggcuacuauccuuccaaccacaucgaggugguuagcgccuacggucugugcgacgcggcuaaucccacuaacuguauagccccagugaauggcuacuuuauuaaaacaaacaauacccggaucgucgacgaauggucauauacagggaguucuuucuacgcacccgagccuaucacuuccuuaaacaccaaguauguggccccacagguaacguaccaaaauauuagcacaaacuugcccccuccgcugcuuucaaacaguaccggaaucgauuuucaggacgagcuggaugaguucuuuaagaaugugagcacuuccauuccaaacuucggcucucuaacccagauaaauacaacucuccuggacuugaccuaugaaaugcugagcuuacaacaggucguuaaagcucucaacgaauccuacaucgaucugaaggagcuugggaauuauacauacuacaacaaauggcccugguauauuuggcugggauuuaucgcaggcuugguggcccucgcgcugugcguguucuuuauucuauguugcacggguugugggaccaauugcaugggaaagcugaaaugcaaccguuguugcgacagauacgaagaguaugaucuugagccucauaagguccacgugcacuga

SEQ ID NO: 698 - RNA, 4062 nt, Artificial Sequence
  derived and/or modified CDS sequence (opt3) from MERS-CoV__ALA49396__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccucaagcaauccaaccugccuaauccuggccacaguaccccacaaccucacuaccauuacaaagccucugaaauauucuuacaucaauaagugcuccagacuucugagugaugacaggaccgaaguuccccaguuggugaacgcaaaucaauauagcccaugugucucuauugugcccuccacugucugggaggacggcgauuacuaccggaaacagcucucaccucuggaaggugggggcugguuaguggccaguggaagcacgguugcuaugacagagcagcugcagaugggcuucgggauaaccgugcaauauggaacugacaccaacucgguaugcccaaagcuagaauuugcgaaugauacaaaaaucgcaucccagcucgguaacugugucgaguacucucuguauggcgugagcgggcguggaguuuuccagaauugcaccgccgugggcguccgccagcaaagauuuguguacgacgcuuaucagaaccuuguagguuacuauucagaugacgggaacuacuacuguuugagggccugcgugaguguuccggucuccgugauuuaugauaaggagacuaagacacaugcaacgcuguucggcucuguggccugugaacacaucagcuccaccaugucacaguacagccggaguacucgaucuaugcucaaacgcagagacuccacauauggaccccugcagaccccugucggcugcguucuugggcuggugaauagcucguuguuuguggaggauuguaagcucccacugggacaaucauuaugcgcucugcccgacacaccuucuacucuaaccccaaggaguguacgguccguccccggugaaaugcgccucgccagcaucgcauucaaccacccgauucagguggaucagcuuaauucuagcuacuuuaaacuuuccauaccuacgaacuucucauuuggcguuacccaagaguauauccagacaacuauucagaaggugaccgucgacuguaaacaguacgugugcaauggguuccaaaagugcgaacaguugcugagagaguauggacaguucuguaguaagaucaaccaggcgcuccauggcgcuaaucugaggcaagaugacagcguucguaacuuauuugccucugugaaauccucacagaguagcccaauuauccccgguuucgggggcgacuuuaaucugacacuuuuggagccuguauccauaucuacuggaucgcggagcgcacgaucagccaucgaagaucuccuguucgacaaggucaccauugcugaucccggcuacaugcagggguacgacgauugcaugcagcaaggaccagccuccgcaagagaccuaaucugugcucaguauguggccggcuacaaagugcugccuccccucauggaugucaacauggaggcggccuauacgaguucucugcuugguagcauugcugggguuggauggacagcaggcuuguccucauuugccgcuaucccauucgcccagucuauauuuuacaggcugaauggugugggcauuacccaacagguauuaagcgaaaaccagaagcucaucgcaaauaaauucaaccaggcgcugggggccaugcaaacuggauuuacaaccacuaaugaggcuuuccgcaaggugcaggacgccgucaacaacaaugcacaggcucuuaguaagcuggccuccgaauugagcaacaccuuuggcgcaauuucugccucaaucggggauauaauccagcggcucgacgugcuggagcaagaugcucagauugacagacuaaucaauggaaggcugacaacgcucaacgcguucguugcccagcagcuggugcgcuccgagagugcagcucuuagcgcccaauuggccaaagauaaggucaaugaaugcgugaaagcucagucgaagcgaucuggcuucuguggucaggggacccacauuguuuccuuuguggucaacgcaccgaauggacuguauuucaugcauguaggcuacuauccuagcaaccacaucgaggugguuucagccuacgguuuaugcgacgcggcuaaucccacuaacuguauagccccagugaauggcuacuuuauuaaaacaaacaauacccggaucgucgacgaauggaguuauacagggucuuccuucuacgcacccgagccuaucacuagccucaacaccaaguauguggccccacagguaacguaccaaaauauuucaacaaaccugcccccuccgcuucugaguaacagcaccggaaucgauuuucaggacgagcuagaugaguucuuuaagaauguguccacuucuauuccaaacuucggcagccucacccagauaaauacaacucuguuggaccugaccuaugaaauguuaucccuccaacaggucguuaaagcucugaacgaaucauacaucgaucuuaaggagcuggggaauuauacauacuacaacaaauggcccugguauauuugguugggauuuaucgcaggccucguggcccuggcgcuaugcguguucuuuauucuguguugcacggguugugggaccaauugcaugggaaagcugaaaugcaaccguuguugcgacagauacgaagaguaugaucucgagccucauaagguccacgugcacuga

SEQ ID NO: 699 - RNA, 4062 nt, Artificial Sequence
  derived and/or modified CDS sequence (opt3) from MERS-CoV__ALA49451__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaguucgcgaaugauacaaaaaucgcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaagacacaugcaacgcuguuuggcuccguggccugugaacacaucucuagcaccaugucccaguacucacggagcacucgaaguaugcucaaacgcagagacucuacauauggaccccugcagaccccugucggcugcguucuugggcugguaaauuccagcuuguucguggaggauuguaaccucccacugggacaaucguuaugcgcucugcccgacacaccuucaacucuaaccccaaggucugugcggaguguccccggugaaaugcgccucgccuccaucgcauuuaaucacccgauucagguggaucagcugaacagcucuuacuucaaacuuagcauaccuacgaauuuuuccuucggcguuacccaagaguauauccagacaacuauucagaaggugaccgucgacuguaagcaguacgugugcaacggguuccaaaaaugcgaacaguugcugagagaguauggacaguuuuguucaaagaucaaucaggcgcuccauggcgcuaaccugaggcaagaugacaguguucguaauuuauucgccagcgugaagucuucccagucaaguccaauuauccccgguuuugggggcgacuucaaccugacacuuuuggagccuguaagcauauccacuggaucucggucggcacgaagcgccaucgaagaucuccuguuugacaaagucaccauugcugaucccggcuacaugcagggguacgacgauugcaugcagcaaggaccagccucagcaagagaccuaaucugugcucaguauguggccggcuacaaggugcugccuccccucauggaugucaauauggaggcggccuauacguccagucugcuugguucuauugcugggguuggauggacagcaggcuugagcuccuucgccgcuaucccauuugcccagucaauauucuacaggcugaacggugugggcauuacccaacagguauuaucugaaaaucagaaacucaucgcaaacaaguuuaaucaggcgcugggggccaugcaaacuggauucacaaccacuaacgaggcuuuucgcaaagugcaggacgccgucaacaauaacgcacaggcucuuagcaagcuggccagugaauuguccaauaccuucggcgcaauuagcgccucuaucggggauauaauccagcggcucgacgugcuggagcaagaugcucagauugacagacuaaucaacggaaggcugacaacgcucaaugcguucguugcccagcagcuggugcgcucagaguccgcagcucuuagugcccaauuggccaaggauaaagucaacgaaugcgugaaggcucagagcaaacgaucgggcuuuuguggucaggggacccacauuguuucuuucguggucaaugcaccgaacggacuguauuuuaugcauguaggcuacuauccuuccaaucacaucgaggugguuagcgccuacgguuuaugcgacgcggcuaaccccacuaauuguauagccccagugaacggcuacuucauuaagacaaauaacacccggaucgucgacgaauggucauauacagggaguucuuuuuacgcacccgagccuaucacuucccucaauaccaaauauguggccccacagguaacguaccaaaacauuagcacaaaccugcccccuccgcuucugggaaauucaaccggcaucgauuuccaggacgagcuagaugaauuuuucaagaacgugaguacuagcauuccaaauuuugggucccucacccagauaaacacaacucuguuggaccugaccuaugagauguuaucucuccaacaggucguuaaggcucugaaugaaagcuacaucgaucuuaaagagcugggaaacuauacauacuacaauaaguggcccugguauauuugguugggcuucaucgcaggucucguggcccuggcgcuaugcguguuuuucauucuguguugcacgggguguggaaccaacugcaugggcaaacuuaagugcaaucguuguugcgacagauacgaagaguaugaucucgagccucauaaaguccacgugcacuga

SEQ ID NO: 700 - RNA, 4062 nt, Artificial Sequence
  derived and/or modified CDS sequence (opt3) from MERS-CoV__ALA49473__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccaacaaccgauugcagcgacggcaacuauaauaggaacgcgucucucaauuccuucaaggaauacuucaaccugcggaauuguacguuuauguauacuuacaacauaacagaggaugaaauucuggagugguucgguaucacccagacugcacaaggggugcaccucuuuucaagccgcuaugucgacuuauacggaggcaauauguuccaguuugccacacugccgguguacgacaccauuaaauauuacaguaucaucccccacucuauuagauccauacagagcgauaggaaggcuugggccgcauucuauguguacaaacuucagccuuugacguuucugcuagacuucucggucgauggcuauauccggcgcgcuauugacugcggguuuaacgaucucucucaacugcauuguuccuacgagucauucgacguugaaaguggaguguauagcguauccucuuuugaggccaagccaagcgguucaguggucgaacaggcggagggcguggagugcgauuucaguccccuucuguccgggaccccuccacagguuuacaacuuuaaacgauugguguucacaaauuguaacuacaaucucacuaagcuguuaagccuguucucugucaacgacuuuaccugcucacaaaucagucccgccgcaauagcuagcaauuguuauuccucucucauucuugauuacuucucguauccgcugagcaugaaguccgacuugucagugaguucugccggaccuaucagccaguuuaacuacaaacaguccuucucaaaucccacaugccuaauccuggcuacuguaccacacaaccucaccacaauuaccaagccucugaaauauagcuacaucaauaagugcucuagacuucuguccgaugacaggacugaaguuccccaguuggugaacgccaaucaauauaguccaugugucagcauugugcccucuacggucugggaggacggcgauuacuaccggaaacagcucuccccucuggaaggugggggcugguuaguggcaucaggaaguacaguugccaugaccgagcagcugcagaugggcuuugggauaacugugcaauauggaaccgacacaaacagcguaugcccaaagcuagaguucgcuaaugauaccaaaaucgcgucgcagcucgguaacugugucgaauacucccuguauggcgugucugggcguggaguuuuucagaauugcacugcagugggcguccgccagcaaagauucguguacgacgccuaucagaaccuuguagguuacuauagcgaugacgggaacuacuacuguuugagggcuugcgugucaguuccggucagugugauuuaugauaaggagacaaagacgcaugccacccuguuuggcuccguggcaugugaacacaucucuagcacuaugucccaguacucacggagcacacgaaguaugcucaaacgcagagacucuaccuauggaccccugcagacaccugucggcugcguucuugggcugguaaauuccagcuuguucguggaggauuguaagcucccacugggacaaucguuaugcgcccugcccgacacuccuucaacccuaacgccaaggucugugcggaguguccccggugaaaugcgccucgcuuccaucgccuuuaaccacccgauucagguggaucagcugaauagcucuuacuucaaacuuagcauaccuaccaacuuuuccuucggcguuacacaagaguauauccagacuaccauucagaaggugacagucgacuguaaacaguacgugugcaauggguuccaaaagugcgaacaguugcugagagaguauggacaguuuuguucaaagaucaaccaggcacuccauggcgcgaaucugaggcaagaugacaguguucguaacuuauucgcuagcgugaaaucuucccagucaaguccaauuauccccgguuuugggggcgacuucaaucugacucuuuuggagccuguaagcauauccaccggaucucggucggcccgaagcgcaaucgaagaucuccuguuugacaaggucacgauugccgaucccggcuacaugcagggguacgacgauugcaugcagcaaggaccagcuucagccagagaccuaaucugugcacaguauguggcuggcuacaaagugcugccuccccucauggaugucaacauggaggccgcguauacauccagucugcuugguucuauugccgggguuggauggaccgcuggcuugagcuccuucgcagccaucccauuugcucagucaauauucuacaggcugaauggugugggcauuacucaacagguauuaucugaaaaccagaagcucaucgccaauaaauuuaaccaggcacugggggcgaugcaaacaggauucaccacuaccaaugaggccuuucgcaaggugcaggacgcugucaacaacaaugcccaggcacuuagcaagcuggcuagugaauuguccaacacauucggcgccauuagcgcaucuaucggggauauaauccagcggcucgacgugcuggagcaagaugcccagauugacagacuaaucaauggaaggcugacgacccucaacgcuuucguugcgcagcagcuggugcgcucagaguccgccgcacuuagugcucaauuggccaaagauaaggucaaugaaugcgugaaagcccagagcaagcgaucgggcuuuuguggucaggggacucacauuguuucuuucguggucaacgcuccgaauggacuguauuuuaugcauguaggcuacuauccuuccaaccacaucgaggugguuagcgcauacgguuuaugcgacgccgcgaaucccacaaacuguauagcuccagugaauggcuacuucauuaaaaccaacaauacacggaucgucgacgaauggucauauacugggaguucuuuuuacgcccccgagccuaucaccucccucaacacgaaguauguggcaccacagguaacauaccaaaauauuagcaccaaccugcccccuccgcuucugggaaacucaacuggcaucgauuuccaggacgagcuagaugaauuuuucaagaaugugaguaccagcauuccaaacuuugggucccucacacagauaaauacuacccuguuggaccugacauaugagauguuaucucuccaacaggucguuaaagcccugaacgaaagcuacaucgaucuuaaggagcugggaaauuauacguacuacaacaaauggcccugguauauuugguugggcuucaucgcuggucucguggcacuggcccuaugcguguuuuucauucuguguugcaccggguguggaacuaauugcaugggcaaacuuaaguuuaaccguugcugugacagauacgaagaguaugaucucgagccucauaagguccacgugcacuga

SEQ ID NO: 701 - RNA, 4062 nt, Artificial Sequence
  derived and/or modified CDS sequence (opt3) from MERS-CoV__ALA49583__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaguucgcgaaugauacaaaaaucgcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaagacacaugcaacgcuguuuggcuccguggccugugaacacaucucuagcaccaugucccaguacucacggagcacucgaaguaugcucaaacgcagagacucuacauauggaccccugcagaccccugucggcugcguucuugggcugguaaauuccagcuuguucguggaggauuguaagcucccacugggacaaucguuaugcgcucugcccgacacaccuucaacucuaaccccaaggucugugcggaguguccccggugaaaugcgccucgccuccaucgcauuuaaccacccgauucagguggaucagcugaauagcucuuacuucaaacuuagcauaccuacgaacuuuuccuucggcguuacccaagaguauauccagacaacuauucagaaggugaccgucgacuguaaacaguacgugugcaauggguuccaaaagugcgaacaguugcugagagaguauggacaguuuuguucaaagaucaaccaggcgcuccauggcgcuaaucugaggcaagaugacaguguucguaacuuauucgccagcgugaaaucuucccagucaaguccaauuauccccgguuuugggggcgacuucaaucugacacuuuuggagccuguaagcauauccacuggaucucggucggcacgaagcgccaucgaagaucuccuguuugacaaggucaccauugcugaucccggcuacaugcagggguacgacgauugcaugcagcaaggaccagccucagcaagagaccuaaucugugcucaguauguggccggcuacaaagugcugccuccccucauggaugucaacauggaggcggccuauacguccagucugcuugguucuauugcugggguuggauggacagcaggcuugagcuccuucgccgcuaucccauuugcccagucaauauucuacaggcugaauggugugggcauuacccaacagguauuaucugaaaaccagaagcucaucgcaaauaaauuuaaccaggcgcugggggccaugcaaacuggauucacaaccacuaaugaggcuuuucgcaaggugcaggacgccgucaacaacaaugcacaggcucuuagcaagcuggccagugaauuguccaacaccuucggcgcaauuagcgccucuaucggggauauaauccagcggcucgacgugcuggagcaagaugcucagauugacagacuaaucaauggaaggcugacaacgcucaacgcguucguugcccagcagcuggugcgcucagaguccgcagcucuuagugcccaauuggccaaagauaaggucaaugaaugcgugaaagcucagagcaagcgaucgggcuuuuguggucaggggacccacauuguuucuuucguggucaacgcaccgaauggacuguauuuuaugcauguaggcuacuauccuuccaaccacaucgaggugguuagcgccuacgguuuaugcgacgcggcuaaucccacuaacuguauagccccagugaauggcuacuucauuaaaacaaacaauacccggaucgucgacgaauggucauauacagggaguucuuuuuacgcacccgagccuaucacuucccucaacaccaaguauguggccccacagguaacguaccaaaauauuagcacaaaccugcccccuccgcuucugggaaacucaaccggcaucgauuuccaggacgagcuagaugaauuuuucaagaaugugaguacuagcauuccaaacuuugggucccucacccagauaaauacaacucuguuggaccugaccuaugagauguuaucucuccaacaggucguuaaagcucugaacgaaagcuacaucgaucuuaaggagcugggaaauuauacauacuacaacaaauggcccugguauauuugguugggcuucaucgcaggucucguggcccuggcgcuaugcguguuuuucauucuguguugcacgggguguggaaccaauugcaugggcaaacuuaaguuuaaccguugcugugacagauacgaagaguaugaucucgagccucauaagguccacgugcacuga

SEQ ID NO: 702 - RNA, 4062 nt, Artificial Sequence
  derived and/or modified CDS sequence (opt3) from MERS-CoV__ALA49649__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaacccccaaaaaguuauuuguggcgaauuauucucaagacguuaaacaguucgcuaacgguuuugugguccggauaggggccgcagccaauucgacuggaacagugaucauuucacccagcaccagugcuacgauccgcaagauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaagaauacuucaaccugcggaauuguaccuuuauguauacguacaacauaacugaggaugaaauucuggagugguucgguaucacacagaccgcccagggggugcaccucuuuucaagccgcuaugucgacuuauacggaggcaauauguuccaauuugcuacucugccgguguacgacacaauuaaguauuacaguaucaucccccacucuauuagauccauacagagcgauaggaaagccugggcagcuuucuauguguacaaacuucagccuuugaccuuucugcuagacuucucggucgauggcuauauccggcgcgccauugacugcggguuuaacgaucucucucagcugcauuguuccuacgagucauucgacguugaaaguggaguguauagcguauccucuuuugaggcgaucccaagcgguucaguggucgaacaagccgagggcguggagugcgauuucaguccccuucuguccgggacgccuccacagguuuacaacuuuaagcgauugguguucaccaauuguaacuacaaucucacaaagcuguuaagccuguucucugucaacgacuuuacuugcucacagauaagucccgcagcuauugccagcaauuguuauuccucucucauccuugauuacuucucguauccgcugagcaugaaguccgacuugucagugaguucugcuggaccuaucagccaauuuaacuacaaacaguccuucucaaauccaaccugccuaauucuggccacaguaccacacaaccucacuaccaucacaaagccucugaaauauagcuacauuaauaagugcucuagacuucuguccgaugacaggaccgaaguuccccaguuggugaacgcaaaucaguauaguccaugugucagcauagugcccucuacugucugggaggacggcgauuacuaccggaaacaacucuccccucuggaaggugggggcugguuaguggccucaggaaguacgguugcuaugacagagcagcugcagaugggcuuugggaucaccgugcaguauggaacugacaccaacagcguaugcccaaagcuagaguucgcgaaugauacaaaaauugcaucgcaacucgguaacugugucgaauacucccuguauggcgugucugggcguggaguuuuucagaauugcaccgccgugggcguccgccagcagagauucguguacgacgcuuaucauaaccuuguagguuacuauagcgaugacgggaacuacuacuguuugagggccugcgugucaguuccggucagugugaucuaugauaaggagacuaagacacacgcaacgcuguuuggcuccguggccugugaacacaucucuagcaccaugucccaauacucacggagcacucgaaguaugcucaaacgcagagacucuacauauggaccccugcagaccccugucggcugcguucuugggcugguaaauuccagcuuguucguggaggauuguaagcucccacugggacagucguuaugcgcucugcccgacacaccuucaacucuaaccccaaggucugugcggaguguccccggugaaaugcgccucgccuccauugcauuuaaccauccgauacagguggaucaacugaauagcucuuacuucaaacuuagcaucccuacgaacuuuuccuucggcguuacccaggaguauauucagacaacuauccaaaaggugaccgucgacuguaaacaguacgugugcaauggguuccagaagugcgaacaguugcugagagaguauggacaauuuuguucaaagauuaaccaggcgcuccacggcgcuaaucugaggcaggaugacaguguucguaacuuauucgccagcgugaaaucuucccagucaaguccaaucauacccgguuuugggggcgacuucaaucugacacuuuuggagccuguaagcaucuccacuggaucucggucggcacgaagcgccauugaagaucuccuguuugacaaggucaccaucgcugaucccggcuacaugcaaggguacgacgauugcaugcagcagggaccagccucagcaagagaccuaauuugugcucaguauguggccggcuacaaagugcugccuccccucauggaugucaacauggaggcggccuauacguccagucugcuugguucuaucgcugggguuggauggacagcaggcuugagcuccuucgccgcuauaccauuugcccaaucaauuuucuacaggcugaauggugugggcaucacccagcagguauuaucugaaaaccaaaagcucauugcaaauaaauuuaaccaggcgcugggggccaugcagacuggauucacaaccacuaaugaggcuuuucgcaaggugcaggacgccgucaacaacaaugcacaagcucuuagcaagcuggccagugaauuguccaacaccuucggcgcaaucagcgccucuauaggggauaucauucagcggcucgacgugcuggagcaggaugcucagaucgacagacuaauuaauggaaggcugacaacgcucaacgcguucguugcccaacagcuggugcgcucagaguccgcagcucuuagugcccaguuggccaaagauaaggucaaugaaugcgugaaagcucagagcaagcgaucgggcuuuuguggucaagggacccauaucguuucuuucguggucaacgcaccgaauggacuguauuuuaugcacguaggcuacuauccuuccaaccauauagaggugguuagcgccuacgguuuaugcgacgcggcuaaucccacuaacuguauugccccagugaauggcuacuucaucaaaacaaacaauacccggaucgucgacgaauggucauauacagggaguucuuuuuacgcacccgagccuauuacuucccucaacaccaaguauguggccccacagguaacguaccagaauaucagcacaaaccugcccccuccgcuucugucaaacaguaccggaauugauuuccaggacgagcuagaugaauuuuucaagaaugugagcacuuccauaccaaacuuuggcucucucacccaaaucaauacaacucuguuggaccugaccuaugagauguuaagccuccagcaggucguuaaagcucugaacgaauccuacauugaucuuaaggagcuggggaauuauacauacuacaacaaauggcccugguauaucugguugggauucauugcaggccucguggcccuggcgcuaugcguguuuuucauccuguguugcacggguugugggaccaauugcaugggaaaacuuaagugcaaccguuguugcgacagauacgaagaguaugaucucgagccucacaagguccacgugcauuga

SEQ ID NO: 703 - RNA, 4062 nt, Artificial Sequence
  derived and/or modified CDS sequence (opt3) from MERS-CoV__ALA49660__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaauucuacccugcauuuaugcugggcuccucuguaggcaacuucagcgaugggaagaugggacgauuuuucaaucauacucuaguucuccugccagacgguuguggcacccuucugcgugccuuuuacugcauuuuggagcccagauccgggaaccacuguccugcuggaaauucauauacaaguuucgccacuuaccauaccccagcgacagauugcagcgacggcaacuauaauaggaacgcaucucucaauuccuucaaggaauacuuuaaccugcggaauuguaccuucauguauacguacaacaucacugaggaugaaauacuggagugguuugguauuacacagaccgcccaaggggugcaccucuucucaagccgcuaugucgacuuauacggaggcaauauguuucaguucgcuacucugccgguguacgacacaaucaaauauuacaguauuaucccccacucuaucagauccauucagagcgauaggaaggccugggcagcuuuuuauguguacaaacuucagccuuugaccuuccugcuagacuuuucggucgauggcuauauacggcgcgccaucgacugcggguucaacgaucucucucaacugcauuguuccuacgagucauuugacguugaaaguggaguguauagcguauccucuuucgaggcgaagccaagcgguucaguggucgaacaggccgagggcguggagugcgauuuuaguccccuucuguccgggacgccuccacagguuuacaacuucaaacgauugguguucaccaauuguaacuacaaucucacaaagcuguuaagccuguuuucugucaacgacuucacuugcucacaaauuagucccgcagcuaucgccagcaauuguuauuccucucucauacuugauuacuuuucguauccgcugagcaugaaguccgacuugucagugaguucugcuggaccuauuagccaguucaacuacaaacaguccuuuucaaauccaaccugccuaauccuggccacaguaccccacaaccucacuaccaucacaaagccucugaaauauagcuacauuaauaagugcucuagacuucuguccgaugacaggaccgaaguuccccaguuggugaacgcaaaucaauauaguccaugugucagcaucgugcccucuacugucugggaggacggcgauuacuaccggaaacagcucuccccucuggaaggugggggcugguuaguggccucaggaaguacgguugcuaugacagagcagcugcagaugggcuucgggauuaccgugcaauauggaacugacaccaacagcguaugcccaaagcuagaauuugcgaaugauacaaaaauagcaucgcagcucgguaacugugucgaguacucccuguauggcgugucugggcguggaguuuuccagaauugcaccgccgugggcguccgccagcaaagauuuguguacgacgcuuaucagaaccuuguagguuacuauagcgaugacgggaacuacuacuguuugagggccugcgugucaguuccggucagugugaucuaugauaaggagacuaagacacaugcaacgcuguucggcuccguggccugugaacacauuucuagcaccaugucccaguacucacggagcacucgaaguaugcucaaacgcagagacucuacauauggaccccugcagaccccugucggcugcguucuugggcugguaaauuccagcuuguuuguggaggauuguaagcucccacugggacaaucguuaugcgcucugcccgacacaccuucaacucuaaccccaaggucugugcggaguguccccggugaaaugcgccucgccuccaucgcauucaaccacccgauccagguggaucagcugaauagcucuuacuuuaaacuuagcauuccuacgaacuucuccuucggcguuacccaagaguauauacagacaacuauccagaaggugaccgucgacuguaaacaguacgugugcaauggguuucaaaagugcgaacaguugcugagagaguauggacaguucuguucaaagauuaaccaggcgcuccauggcgcuaaucugaggcaagaugacaguguucguaacuuauuugccagcgugaaaucuucccagucaaguccaaucauucccgguuucgggggcgacuuuaaucugacacuuuuggagccuguaagcaucuccacuggaucucggucggcacgaagcgccauagaagaucuccuguucgacaaggucaccaucgcugaucccggcuacaugcagggguacgacgauugcaugcagcaaggaccagccucagcaagagaccuaauuugugcucaguauguggccggcuacaaagugcugccuccccucauggaugucaacauggaggcggccuauacguccagucugcuugguucuaucgcugggguuggauggacagcaggcuugagcuccuuugccgcuauuccauucgcccagucaaucuuuuacaggcugaauggugugggcauaacccaacagguauuaucugacaaccagaagcucauugcaaauaaauucaaccaggcgcugggggccaugcaaacuggauuuacaaccacuaaugaggcuuuccgcaaggugcaggaugccgucaacaacaaugcacaggcucuuagcaagcuggccagugaauuguccaacaccuucggcgcaaucagcgccucuauuggggacaucauacagcggcucgaugugcuggaacaagacgcucagaucgauagacuaauuaauggaaggcugacaacgcucaacgcguuuguugcccagcagcuggugcgcucagaguccgcagcucuuagugcccaauuggccaaagacaaggucaaugagugcgugaaagcucagagcaagcgaucgggcuucuguggucaggggacccacaucguuucuuuuguggucaacgcaccgaauggacuguauuucaugcauguaggcuacuauccuuccaaccacauugaagugguuagcgccuacgguuuaugcgacgcggcuaaucccacuaacuguaucgccccagugaauggcuacuuuauaaaaacaaacaauacccggauugucgaugaguggucauauacagggaguucuuucuacgcacccgaaccuaucacuucccucaacaccaaguauguggccccacagguaacguaccaaaauaucagcacaaaccugcccccuccgcuucugucaaacaguaccggaauugacuuucaggaugagcuagacgaguucuuuaagaaugugagcacuuccaucccaaacuucggcucucucacccagauuaauacaacucuguuggaucugaccuaugaaauguuaagccuccaacaggucguuaaagcucugaacgaguccuacauagaccuuaaggaacuggggaauuauacauacuacaacaaauggcccugguauaucugguugggauuuauugcaggccucguggcccuggcgcuaugcguguucuuuauccuguguugcacggguugugggaccaauugcaugggaaaacuuaagugcaaccguuguugcgauagauacgaggaauaugaccucgagccucauaagguccacgugcacuga

SEQ ID NO: 704 - RNA, 4062 nt, Artificial Sequence
  derived and/or modified CDS sequence (opt3) from MERS-CoV__ALA49671__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacaaacugcagcgauggcaauuauaacaggaaugcaucucucaacuccuucaaggaauacuucaaucugcggaacuguaccuuuauguauacguacaauauaacugaggacgaaauucuggagugguucgguaucacacagaccgcccaaggggugcaccucuuuucaagccgcuaugucgauuuauacggaggcaacauguuccaguuugcuacucugccgguguacgacacaauuaaauauuacaguaucaucccccacucuauuagauccauacagagcgacaggaaggccugggcagcuuucuauguguacaaacuucagccuuugaccuuucugcuagauuucucggucgacggcuauauccggcgcgccauugauugcggguuuaacgaccucucucaacugcauuguuccuacgagucauucgauguugaaaguggaguguauagcguauccucuuuugaggcgaagccaagcgguucaguggucgaacaggccgagggcguggagugcgacuucaguccccuucuguccgggacgccuccacagguuuacaauuuuaaacgauugguguucaccaacuguaauuacaaccucacaaagcuguuaagccuguucucugucaaugauuuuacuugcucacaaaucagucccgcagcuauagccagcaacuguuauuccucucucauucuugacuacuucucguauccgcugagcaugaaguccgauuugucagugaguucugcuggaccuaucagccaguuuaauuacaaacaguccuucucaaacccaaccugccuaauccuggccacaguaccccacaaucucacuaccauuacaaagccucugaaauauagcuacaucaacaagugcucuagacuucuguccgacgauaggaccgaaguuccccaguuggugaaugcaaaccaauauaguccaugugucagcauugugcccucuacugucugggaggacggcgacuacuaccggaaacagcucuccccucuggaaggugggggcugguuaguggccucaggaaguacgguugcuaugacagagcagcugcagaugggcuuugggauaaccgugcaauauggaacugauaccaauagcguaugcccaaagcuagaguucgcgaacgacacaaaaaucgcaucgcagcucgguaauugugucgaauacucccuguauggcgugucugggcguggaguuuuucagaacugcaccgccgugggcguccgccagcaaagauucguguacgaugcuuaucagaaccuuguagguuacuauagcgacgaugggaauuacuacuguuugagggccugcgugucaguuccggucagugugauuuaugacaaggagacuaagacacaugcaacgcuguuuggcuccguggccugugaacacaucucuagcaccaugucccaguacucacggagcacucgaaguaugcucaaacgcagagauucuacauauggaccccugcagaccccugucggcugcguucuugggcuggugaacuccagcuuguucguggaggacuguaagcucccacugggacaaucguuaugcgcucugcccgauacaccuucaacucuaaccccaaggucuguacggaguguccccggugaaaugcgccucgccuccaucgcauuuaaucacccgauucagguggaccagcugaacagcucuuacuucaaacuuagcauaccuacgaauuuuuccuucggcguuacccaagaguauauccagacaacuauucagaaggugaccgucgauuguaaacaguacgugugcaacggguuccaaaagugcgaacaguugcugagagaguauggacaguuuuguucaaagaucaaucaggcgcuccauggcgcuaaccugaggcaagacgauaguguucguaauuuauucgccagcgugaaaucuucccagucaaguccaauuauccccgguuuugggggcgacuucaaccugacacuuuuggagccuguaagcauauccacuggaucucggucggcacgaagcgccaucgaagaccuccuguuugauaaggucaccauugcugaccccggcuacaugcagggguacgaugacugcaugcagcaaggaccagccucagcaagagaucuaaucugugcucaguauguggccggcuacaaagugcugccuccccucauggacgucaauauggaggcggccuauacguccagucugcuugguucuauugcugggguuggauggacagcaggcuugagcuccuucgccgcuaucccauuugcccagucaauauucuacaggcugaacggugugggcauuacccaacagguauuaucugauaaucagaagcucaucgcaaacaaauuuaaucaggcgcugggggccaugcaaacuggauucacaaccacuaacgaggcuuuucgcaaggugcaggacgccgucaacaauaacgcacaggcucuuagcaagcuggccagugaauuguccaauaccuucggcgcaauuagcgccucuaucggggauauaauccagcggcucgacgugcuggaacaagaugcucagauugacagacuaaucaacggaaggcugacaacgcucaaugcguucguugcccagcagcuggugcgcucagaguccgcagcucuuagugcccaauuggccaaagauaaggucaacgagugcgugaaagcucagagcaagcgaucgggcuuuuguggucaggggacccacauuguuucuuucguggucaaugcaccgaacggacuguauuuuaugcauguaggcuacuauccuuccaaucacaucgaagugguuagcgccuacgguuuaugcgacgcggcuaaccccacuaauuguauagccccagugaacggcuacuucauuaaaacaaauaacacccggaucgucgacgaguggucauauacagggaguucuuuuuacgcacccgaaccuaucacuucccucaauaccaaguauguggccccacagguaacguaccaaaacauuagcacaaaccugcccccuccgcuucugucaaauaguaccggaaucgauuuccaggacgagcuagaugaguuuuucaagaacgugagcacuuccauuccaaauuuuggcucucucacccagauaaacacaacucuguuggaccugaccuaugaaauguuaagccuccaacaggucguuaaagcucugaaugaguccuacaucgaucuuaaggaacuggggaacuauacauacuacaauaaauggcccugguauauuugguugggauucaucgcaggccucguggcccuggcgcuaugcguguuuuucauucuguguugcacggguugugggaccaacugcaugggaaaacuuaagugcaaucguuguugcgacagauacgaggaauaugaucucgagccucauaagguccacgugcacuga

SEQ ID NO: 705 - RNA, 4062 nt, Artificial Sequence
  derived and/or modified CDS sequence (opt3) from MERS-CoV__ALA49682__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaguucgcgaaugauacaaaaaucgcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaagacacaugcaacgcuguuuggcuccguggccugugaacacaucucuagcaccaugucccaguacucacggagcacucgaaguaugcucaaacgcagagacucuacauauggaccccugcagaccccugucggcugcguucuugggcugguaaauuccagcuuguucguggaggauuguaagcucccacugggacaaucguuaugcgcucugcccgacacaccuucaacucuaaccccaaggucugugcggaguguccccggugaaaugcgccucgccuccaucgcauuuaaccacccgauucagguggaucagcugaauagcucuuacuucaaacuuagcauaccuacgaacuuuuccuucggcguuacccaagaguauauccagacaacuauucagaaggugaccgucgacuguaaacaguacgugugcaauggguuccaaaagugcgaacaguugcugagagaguauggacaguuuuguucaaagaucaaccaggcgcuccauggcgcuaaucugaggcaagaugacaguguucguaacuuauucgccagcgugaaaucuucccagucaaguccaauuauccccgguuuugggggcgacuucaaucugacacuuuuggagccuguaagcauauccacuggaucucggucggcacgaagcgccaucgaagaucuccuguuugacaaggucaccauugcugaucccggcuacaugcagggguacgacgauugcaugcagcaaggaccagccucagcaagagaccuaaucugugcucaguauguggccggcuacaaagugcugccuccccucauggaugucaacauggaggcggccuauacguccagucugcuugguucuauugcugggguuggauggacagcaggcuugagcuccuucgccgcuaucccauuugcccagucaauauucuacaggcugaauggugugggcauuacccaacagguauuaucugaaaaccagaagcucaucgcaaauaaauuuaaccaggcgcugggggccaugcaaacuggauucacaaccacuaaugaggcuuuucgcaaggugcaggacgccgucaacaacaaugcacaggcucuuagcaagcuggccagugaauuguccaacaccuucggcgcaauuagcgccucuaucggggauauaauccagcggcucgacgugcuggagcaagaugcucagauugacagacuaaucaauggaaggcugacaacgcucaacgcguucguugcccagcagcuggugcgcucagaguccgcagcucuuagugcccaauuggccaaagauaaggucaaugaaugcgugaaagcucagagcaagcgaucgggcuuuuguggucaggggacccacauuguuucuuucguggucaacgcaccgaauggacuguauuuuaugcauguaggcuacuauccuuccaaccacaucgaggugguuagcgccuacgguuuaugcgacgcggcuaaucccacuaacuguauagccccagugaauggcuacuucauuaaaacaaacaauacccggaucgucgacgaauggucauauacagggaguucuuuuuacgcacccgagccuaucacuucccucaacaccaaguauguggccccacagguaacguaccaaaauauuagcacaaaccugcccccuccgcuucugucaaacaguaccggaaucgauuuccaggacgagcuagaugaauuuuucaagaaugugagcacuuccauuccaaacuuuggcucucucacccagauaaauacaacucuguuggaccugaccuaugagauguuaagccuccaacaggucguuaaagcucugaacgaauccuacaucgaucuuaaggagcuggggaauuauacauacuacaacaaauggcccugguauauuugguugggauucaucgcaggccucguggcccuggcgcuaugcguguuuuucauucuguguugcacggguugugggaccaauugcaugggaaaacuuaagugcaaccguuguugcgacagauacgaagaguaugaucucgagccucauaagguccacgugcacuga

SEQ ID NO: 706 - RNA, 4062 nt, Artificial Sequence
  derived and/or modified CDS sequence (opt3) from MERS-CoV__ALA49803__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggaucgguaugucuacuccgcaggacacgccaccggcacaaccccacaaaaauuauuuguggcgaauuauucucaggacguuaagcaguucgcuaacgguuuugugguccgcauaggggccgcagccaauucgacuggaacagugaucauuucacccagcaccagugcuacgauccgaaaaauuuacccugcauucaugcugggcuccucuguaggcaacuuuagcgaugggaagaugggacguuucuuuaaucauacucuaguucuccugccagacgguuguggcacccuucugagagccuucuacugcaucuuggagcccagguccgggaaccacuguccugcuggaaauucauauacaaguuuugccacuuaccauaccccaagcacagauugcucugacggcaacuauaaucggaacgcgucccucaauucauucaaggaauacuucaaccugcgcaauuguaccuuuauguauacguacaacauaacugaggaugaaauucuggagugguucgguaucacacagaccgcacaaggggugcaccucuuuagcaguagauaugucgacuuauacggaggcaauauguuccaguuugccacucugccgguguacgacacaauuaaauauuacucuaucaucccccacuccauuaggagcauacagucggaucggaaggcuugggccgcauucuauguguacaaacuucagccuuugaccuuucugcuagacuucucugucgauggcuauauccgccgagcuauugacugcggguuuaacgaucucucccaacugcauuguucauacgagaguuucgacguugaaagcggaguguauuccguaucuagcuuugaggccaagccaucagguaguguggucgaacaggcggagggcguggagugcgauuucagcccccuucuguccgggacgccuccacagguuuacaacuuuaaaagauugguguucaccaauuguaacuacaaucucacaaagcuguuaucucuguucucagucaacgacuuuacuugcagucaaaucagccccgccgcaauagcuuccaauuguuauucuucgcucauucuugauuacuucagcuauccgcuguccaugaagucagacuugagugugucuagcgccggaccuaucucccaguuuaacuacaaacagucauucagcaauccaaccugccuaauccuggcuacaguaccccacaaccucacuaccauuacaaagccucugaaauauucuuacaucaauaagugcuccaggcuucugagugaugaccggaccgaaguuccccaguuggugaacgccaaucaauauagcccaugugucucuauugugcccuccacugucugggaggacggcgauuacuaccguaaacagcucucaccucuggaaggugggggcugguuaguggcaaguggaagcacgguugccaugacagagcagcugcagaugggcuuugggauaaccgugcaauauggaacugacaccaacucgguaugcccaaagcuagaguucgcuaaugauacaaaaaucgcgucccagcucgguaacugugucgaauacucucuguauggcgugagcgggcgcggaguuuuucagaauugcaccgcagugggcgucagacagcaaagguucguguacgacgccuaucagaaccuuguagguuacuauucagaugacgggaacuacuacuguuugcgggcuugcgugaguguuccggucuccgugauuuaugauaaggagacuaagacacaugccacgcuguuuggcucuguggcaugugaacacaucagcuccaccaugucacaguacagccgaaguacucgcucuaugcucaaaagaagggacuccacauauggaccccugcagaccccugucggcugcguucuugggcuggugaauagcucguuguucguggaggauuguaagcucccacugggacaaucauuaugcgcccugcccgacacaccuucuacucuaaccccacggaguguacgcuccguccccggugaaaugagacucgcuagcaucgccuuuaaccacccgauucagguggaucagcuuaauucuagcuacuucaaacuuuccauaccuacgaacuuuucauucggcguuacccaagaguauauccagacaacuauucagaaggugaccgucgacuguaaacaguacgugugcaauggguuccaaaagugcgaacaguugcugagggaguauggacaguuuuguaguaagaucaaccaggcacuccauggcgcgaaucugcgucaagaugacagcguucggaacuuauucgcuucugugaaauccucacagaguagcccaauuauccccgguuuugggggcgacuucaaucugacacuuuuggagccuguauccauaucuacuggaucgcgaagcgccagaucagcaaucgaagaucuccuguuugacaaggucaccauugccgaucccggcuacaugcagggguacgacgauugcaugcagcaaggaccagcuuccgccagggaccuaaucugugcacaguauguggcuggcuacaaagugcugccuccccucauggaugucaacauggaggccgcguauacgaguucucugcuugguagcauugccgggguuggauggacagcuggcuuguccucauucgcagccaucccauuugcucagucuauauucuaccgccugaauggugugggcauuacccaacagguauuaagcgaaaaccagaagcucaucgccaauaaauuuaaccaggcacugggggcgaugcaaacuggauucacaaccacuaaugaggccuuucggaaggugcaggacgcugucaacaacaaugcccaggcacuuaguaagcuggcuuccgaauugagcaacaccuucggcgccauuucugcaucaaucggggauauaauccagagacucgacgugcuggagcaagaugcccagauugacaggcuaaucaauggacgccugacaacgcucaacgcuuucguugcgcagcagcuggugcgauccgagagugccgcacuuagcgcucaauuggccaaagauaaggucaaugaaugcgugaaagcccagucgaagcggucuggcuuuuguggucaggggacccacauuguuuccuucguggucaacgcuccgaauggacuguauuuuaugcauguaggcuacuauccuagcaaccacaucgaggugguuucagcauacgguuuaugcgacgccgcgaaucccacuaacuguauagcuccagugaauggcuacuucauuaaaacaaacaauacccgugucguggacgaauggaguuauacagggucuuccuuuuacgcccccgagccuaucacuagccucaacaccaaguauguagcaccacaggugacguaccaaaauaucucaacaaaccugcccccuccgcuucugaguaacagcaccggaauugauuuccaggacgagcuagaugaauuuuucaagaaugucuccacuucuaucccaaacuuuggcagccucacccagauuaauacaacucuguuggaccugaccuaugagauguuaucccuccaacagguugugaaagcccugaacgaaucauacauagaucuuaaggagcuggggaauuauacauacuacaacaaauggcccugguauaucugguugggauucauugcuggccucguggcacuggcccuaugcgucuuuuucauccuguguugcacggguugugggaccaauugcaugggaaagcugaaaugcaacagauguugcgacagguacgaagaguaugaucucgagccucauaaggugcacguucacuga

SEQ ID NO: 707 - RNA, 4062 nt, Artificial Sequence
  derived and/or modified CDS sequence (opt3) from MERS-CoV__ALA49836__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccucaagcaauccaaccugccuaauccuggccacaguaccccacaaccucacuaccauuacaaagccucugaaauauucuuacaucaauaagugcuccagacuucugagugaugacaggaccgaaguuccccaguuggugaacgcaaaucaauauagcccaugugucucuauugugcccuccacugucugggaggacggcgauuacuaccggaaacagcucucaccucuggaaggugggggcugguuaguggccaguggaagcacgguugcuaugacagagcagcugcagaugggcuucgggauaaccgugcaauauggaacugacaccaacucgguaugcccaaagcuagaauuugcgaaugauacaaaaaucgcaucccagcucgguaacugugucgaguacucucuguauggcgugagcgggcguggaguuuuccagaauugcaccgccgugggcguccgccagcaaagauuuguguacgacgcuuaucagaaccuuguagguuacuauucagaugacgggaacuacuacuguuugagggccugcgugaguguuccggucuccgugauuuaugauaaggagacuaagacacaugcaacgcuguucggcucuguggccugugaacacaucagcuccaccaugucacaguacagccggaguacucgaucuaugcucaaacgcagagacuccacauauggaccccugcagaccccugucggcugcguucuugggcuggugaauagcucguuguuuguggaggauuguaagcucccacugggacaaucauuaugcgcucugcccgacacaccuucuacucuaaccccaaggaguguacgguccguccccggugaaaugcgccucgccagcaucgcauucaaccacccgauucagguggaucagcuuaauucuagcuacuuuaaacuuuccauaccuacgaacuucucauuuggcguuacccaagaguauauccagacaacuauucagaaggugaccgucgacuguaaacaguacgugugcaauggguuccaaaagugcgaacaguugcugagagaguauggacaguucuguaguaagaucaaccaggcgcuccauggcgcuaaucugaggcaagaugacagcguucguaacuuauuugccucugugaaauccucacagaguagcccaauuauccccgguuucgggggcgacuuuaaucugacacuuuuggagccuguauccauaucuacuggaucgcggagcgcacgaucagccaucgaagaucuccuguucgacaaggucaccauugcugaucccggcuacaugcagggguacgacgauugcaugcagcaaggaccagccuccgcaagagaccuaaucugugcucaguauguggccggcuacaaagugcugccuccccucauggaugucaacauggaggcggccuauacgaguucucugcuugguagcauugcugggguuggauggacagcaggcuuguccucauuugccgcuaucccauucgcccagucuauauuuuacaggcugaauggugugggcauuacccaacagguauuaagcgaaaaccagaagcucaucgcaaauaaauucaaccaggcgcugggggccaugcaaacuggauuuacaaccacuaaugaggcuuuccgcaaggugcaggacgccgucaacaacaaugcacaggcucuuaguaagcuggccuccgaauugagcaacaccuuuggcgcaauuucugccucaaucggggauauaauccagcggcucgacgugcuggagcaagaugcucagauugacagacuaaucaauggaaggcugacaacgcucaacgcguucguugcccagcagcuggugcgcuccgagagugcagcucuuagcgcccaauuggccaaagauaaggucaaugaaugcgugaaagcucagucgaagcgaucuggcuucuguggucaggggacccacauuguuuccuuuguggucaacgcaccgaauggacuguauuucaugcauguaggcuacuauccuagcaaccacaucgaggugguuucagccuacgguuuaugcgacgcggcuaaucccacuaacuguauagccccagugaauggcuacuuuauuaaaacaaacaauacccggaucgucgacgaauggaguuauacagggucuuccuucuacgcacccgagccuaucacuagccucaacaccaaguauguggccccacagguaacguaccaaaauauuucaacaaaccugcccccuccgcuucugggaaacaguaccggcaucgauuuucaggacgagcuagaugaguucuuuaagaaugugagcacuuccauuccaaacuucgggucucucacccagauaaauacaacucuguuggaccugaccuaugaaauguuaagccuccaacaggucguuaaagcucugaacgaauccuacaucgaucuuaaggagcugggaaauuauacauacuacaacaaauggcccugguauauuugguugggcuuuaucgcaggucucguggcccuggcgcuaugcguguucuuuauucuguguugcacgggguguggaaccaauugcaugggcaagcugaaaugcaaccguuguugcgacagauacgaagaguaugaucucgagccucauaagguccacgugcacuga

SEQ ID NO: 708 - RNA, 4062 nt, Artificial Sequence
  derived and/or modified CDS sequence (opt3) from MERS-CoV__ALA49957__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaguucgcgaaugauacaaaaaucgcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaagacacaugcaacgcuguuuggcuccguggccugugaacacaucucuagcaccaugucccaguacucacggagcacucgaaguaugcucaaacgcagagacucuacauauggaccccugcagaccccugucggcugcguucuugggcugguaaauuccagcuuguucguggaggauuguaagcucccacugggacaaucguuaugcgcucugcccgacacaccuucaacucuaaccccaaggucugugcggaguguccccggugaaaugcgccucgccuccaucgcauuuaaccacccgauucagguggaucagcugaauagcucuuacuucaaacuuagcauaccuacgaacuuuuccuucggcguuacccaagaguauauccagacaacuauucagaaggugaccgucgacuguaaacaguacgugugcaauggguuccaaaagugcgaacaguugcugagagaguauggacaguuuuguucaaagaucaaccaggcgcuccauggcgcuaaucugaggcaagaugacaguguucguaacuuauucgccagcgugaaaucuucccagucaaguccaauuauccccgguuuugggggcgacuucaaucugacacuuuuggagccuguaagcauauccacuggaucucggucggcacgaagcgccaucgaagaucuccuguuugacaaggucaccauugcugaucccggcuacaugcagggguacgacgauugcaugcagcaaggaccagccucagcaagagaccuaaucugugcucaguauguggccggcuacaaagugcugccuccccucauggaugucaacauggaggcggccuauacguccagucugcuugguucuauugcugggguuggauggacagcaggcuugagcuccuucgccgcuaucccauuugcccagucaauauucuacaggcugaauggugugggcauuacccaacagguauuaucugaaaaccagaagcucaucgcaaauaaauuuaaccaggcgcugggggccaugcaaacuggauucacaaccacuaaugaggcuuuucgcaaggugcaggacgccgucaacaacaaugcacaggcucuuagcaagcuggccagugaauuguccaacaccuucggcgcaauuagcgccucuaucggggauauaauccagcggcucgacgugcuggagcaagaugcucagauugacagacuaaucaauggaaggcugacaacgcucaacgcguucguugcccagcagcuggugcgcucagaguccgcagcucuuagugcccaauuggccaaagauaaggucaaugaaugcgugaaagcucagagcaagcgaucgggcuuuuguggucaggggacccacauuguuucuuucguggucaacgcaccgaauggacuguauuuuaugcauguaggcuacuauccuuccaaccacaucgaggugguuagcgccuacgguuuaugcgacgcggcuaaucccacuaacuguauagccccagugaauggcuacuucauuaaaacaaacaauaccacaaucgucgacgaauggucauauacugggaguucuuuuuacgcacccgagccuaucaccucccucaacacgaaguauguggccccacagguaacauaccaaaauauuagcaccaaccugcccccuccgcuucugggaaacucaacuggcaucgauuuccaggacgagcuagaugaauuuuucaagaaugugaguaccagcauuccaaacuuugggucccucacacagauaaauacuacccuguuggaccugacauaugagauguuaucucuccaacaggucguuaaagcucugaacgaaagcuacaucgaucuuaaggagcugggaaauuauacguacuacaacaaauggcccugguauauuugguugggcuucaucgcaggucucguggcccuggcgcuaugcguguuuuucauucuguguugcaccggguguggaacuaauugcaugggcaaacuuaagugcaaccgguguugcgaccguuacgaagaguaugaucucgagccucauaagguccacgugcacuga

SEQ ID NO: 709 - RNA, 4062 nt, Artificial Sequence
  derived and/or modified CDS sequence (opt3) from MERS-CoV__ALA50067__S
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucuagcggaccuaucucccaguuuaacuacaaacagucauucagcaauccaaccugccuaauccuggcuacaguaccccacaaccucacuaccauuacaaagccucugaaauauucuuacaucaauaagugcuccagacuucugagugaugacaggaccgaaguuccccaguuggugaacgccaaucaauauagcccaugugucucuauugugcccuccacugucugggaggacggcgauuacuaccggaaacagcucucaccucuggaaggugggggcugguuaguggcaaguggaagcacgguugccaugacagagcagcugcagaugggcuuugggauaaccgugcaauauggaacugacaccaacucgguaugcccaaagcuagaguucgcuaaugauacaaaaaucgcgucccagcucgguaacugugucgaauacucucuguauggcgugagcgggcguggaguuuuucagaauugcaccgcagugggcguccgccagcaaagauucguguacgacgccuaucagaaccuuguagguuacuauucagaugacgggaacuacuacuguuugagggcuugcgugaguguuccggucuccgugauuuaugauaaggagacuaagacacaugccacgcuguuuggcucuguggcaugugaacacaucagcuccaccaugucacaguacagccggaguacucgaucuaugcucaaacgcagagacuccacauauggaccccugcagaccccugucggcugcguucuugggcuggugaauagcucguuguucguggaggauuguaagcucccacugggacaaucauuaugcgcccugcccgacacaccuucuacucuaaccccaaggaguguacgguccguccccggugaaaugcgccucgcuagcaucgccuuuaaccacccgauucagguggaucagcuuaauucuagcuacuucaaacuuuccauaccuacgaacuuuucauucggcguuacccaagaguauauccagacaacuauucagaaggugaccgucgacuguaaacaguacgugugcaauggguuccaaaagugcgaacaguugcugagagaguauggacaguuuuguaguaagaucaaccaggcacuccauggcgcgaaucugaggcaagaugacagcguucguaacuuauucgcuucugugaaauccucacagaguagcccaauuauccccgguuuugggggcgacuucaaucugacacuuuuggagccuguauccauaucuacuggaucgcggagcgcccgaucagcaaucgaagaucuccuguuugacaaggucaccauugccgaucccggcuacaugcagggguacgacgauugcaugcagcaaggaccagcuuccgccagagaccuaaucugugcacaguauguggcuggcuacaaagugcugccuccccucauggaugucaacauggaggccgcguauacgaguucucugcuugguagcauugccgggguuggauggacagcuggcuuguccucauucgcagccaucccauuugcucagucuauauucuacaggcugaauggugugggcauuacccaacagguauuaagcgaaaaccagaagcucaucgccaauaaauuuaaccaggcacugggggcgaugcaaacuggauucacaaccacuaaugaggccuuucgcaaggugcaggacgcugucaacaacaaugcccaggcacuuaguaagcuggcuuccgaauugagcaacaccuucggcgccauuucugcaucaaucggggauauaauccagcggcucgacgugcuggagcaagaugcccagauugacagacuaaucaauggaaggcugacaacgcucaacgcuuucguugcgcagcagcuggugcgcuccgagagugccgcacuuagcgcucaauuggccaaagauaaggucaaugaaugcgugaaagcccagucgaagcgaucuggcuuuuguggucaggggacccacauuguuuccuucguggucaacgcuccgaauggacuguauuuuaugcauguaggcuacuauccuagcaaccacaucgaggugguuucagcauacgguuuaugcgacgccgcgaaucccacuaacuguauagcuccagugaauggcuacuucauuaaaacaaacaauacccggaucgucgacgaauggaguuauacagggucuuccuuuuacgcccccgagccuaucacuagccucaacaccaaguauguggcaccacagguaacguaccaaaauauuucaacaaaccugcccccuccgcuucugaguaacagcaccggaaucgauuuccaggacgagcuagaugaauuuuucaagaauguguccacuucuauuccaaacuuuggcagccucacccagauaaauacaacucuguuggaccugaccuaugagauguuaucccuccaacaggucguuaaagcccugaacgaaucauacaucgaucuuaaggagcuggggaauuauacauacuacaacaaauggcccugguauauuugguugggauucaucgcuggccucguggcacuggcccuaugcguguuuuucauucuguguugcacggguugugggaccaauugcaugggaaagcugaaaugcaaccguuguugcgacagauacgaagaguaugaucucgagccucauaagguccacgugcacuga

SEQ ID NO: 710 - RNA, 249 nt, Artificial Sequence
  derived and/or modified CDS sequence (opt3) from MERS-CoV__AGH58723__E
augcugcccuucgugcaggagagaaucggccucuuuauugucaacuucuuuauauucaccguugugugcgccaucacacuucugguauguauggcauuuuugacugcuacgagguuaugcgugcaauguaugaccggguucaauacacugcuaguccagccugcccucuaccuguauaacacuggacggagcguguacguuaaguuucaggacuccaaaccaccgcuucccccugaugaauggguguga

SEQ ID NO: 711 - RNA, 249 nt, Artificial Sequence
  derived and/or modified CDS sequence (opt3) from MERS-CoV__AGV08472__E
augcugcccuucgugcaggagagagucggccucuuuaucguuaacuucuuuauuuucaccgugguaugcgccauaacacuucugguguguauggcauuuuugacugcuacgagguuaugcguccaauguaugaccggguucaauacacugcuagugcagccugcccucuaccuguauaacacuggacggagcguuuacgugaaguuucaggacuccaaaccaccgcuucccccugaugaaugggucuga

SEQ ID NO: 712 - RNA, 249 nt, Artificial Sequence
  derived and/or modified CDS sequence (opt3) from MERS-CoV__AGV08540__E
augcugcccuucgugcaggagagaaucggccucuuuauugucaaguucuuuauauucaccguugugugcgccaucacacuucugguauguauggcauuuuugacugcuacgagguuaugcgugcaauguaugaccggguucaacacacugcuaguccagccugcccucuaccuguauaauacuggacggagcguguacguuaaauuucaggacuccaagccaccgcuucccccugaugaauggguguga

SEQ ID NO: 713 - RNA, 249 nt, Artificial Sequence
  derived and/or modified CDS sequence (opt3) from MERS-CoV__ALX27237__E
augcugcccuucgugcaggagagaaucggccucuuuauugucaacuucuuuauauucaccguugugugcgccaucacacuucugguauguauggcauuuuugacugcuacgagguuaugcgugcaauguaugaccggguucaauacacugcuaguccagccugcccucuaccuguauaacacuggacggagcguguacguuaaguuucaggacuccaaaccaccgcuucccucugaugaauggguguga

SEQ ID NO: 714 - RNA, 249 nt, Artificial Sequence
  derived and/or modified CDS sequence (opt3) from MERS-CoV__ALR69646__E
augcugcccuucgugcaggagagaaucggccucuuuauugucaacuucuuuauauucaccguugugugcgccaucacacuucugguauguauggcauuuuugacugcuacgagguuaugcgugcaauguauuaccggguucaauacacugcuaguccagccugcccucuaccuguauaacacuggacggagcguguacguuaaguuucaggacuccaaaccaccgcuucccccugaugaauggguguga

SEQ ID NO: 715 - RNA, 249 nt, Artificial Sequence
  derived and/or modified CDS sequence (opt3) from MERS-CoV__ALA49346__E
augcugcccuucgugcaggagagaaucggccucuuuauugucaacuucagcauauuuaccguugugugcgccaucacacuucugguauguauggcuuucuugacugcaacgagguuaugcgugcaauguaugaccggguuuaauacacugcuaguccagccugcccucuaccuguauaacacuggacgguccguguacguuaaguuccaggacucuaaaccaccgcuucccccugaugaauggguguga

SEQ ID NO: 716 - RNA, 249 nt, Artificial Sequence
  derived and/or modified CDS sequence (opt3) from MERS-CoV__ALA49390__E
augcugcccuucgugcaggagagaaucggccucuuuauugucaacuucuuuauauucaccguugugugcgccaucacacuucugguauguauggcauuuuugacugcuacgagguuaugcgugcaauguaugaccgggcugaauacacuacucguccagccugcccuguaccuuuauaacacuggacggagcguguacguuaaguuccaggacuccaaaccaccgcugcccccugaugaauggguguga

SEQ ID NO: 717 - RNA, 660 nt, Artificial Sequence
  derived and/or modified CDS sequence (opt3) from MERS-CoV__AFS88942__M
augagcaacaugacccagcugacagaggcccaaaucauugcuauaaucaaggacuggaauuucgcauggucccucauuuuucuucugaucacuauuguguugcaguacggcuaucccucuagaucaaugacggucuacguuuucaaaauguuuguguuauggcugcuauggccuaguagcauggcccucuccaucuucucugcgguauauccaauagaucuggcuucgcagaucauuucagggaucguggccgcagucagcgccaugauguggauuaguuacuuugugcaguccaucaggcuuuucaugcggaccggaucuugguggagcuuuaacccggaaacaaauugccuguugaacguucccuucgguggcacuaccgugguccgcccucucguggaggacuccacaucaguaaccgcuguugugacuaaugggcaccugaagauggcaggaaugcauuuuggcgccugugauuaugaccgacugccaaacgaagucacaguggcuaaacccaaugugcucauagccuuaaagauggucaaacgucaaaguuacgguaccaacagcgggguugcgauuuaucacagauacaaggcaggaaauuacaggucuccuccaaucacggccgauauugagcuggcucuuuugcgggccuga

SEQ ID NO: 718 - RNA, 660 nt, Artificial Sequence
  derived and/or modified CDS sequence (opt3) from MERS-CoV__AGH58718__M
augagcaacaugacccagcugacagaggcccaaaucauugcugugauaaaggacuggaauuucgcauggucccucaucuuucuucugauuacuaucgucuugcaguacggcuaucccucuagaucaaugacgguuuacguguucaaaauguuuguauuauggcugcuauggccuaguagcauggcccucuccauuuucucuaccguguauccaaucgaucuggcgucgcagauaaucucagggauugucgcugccgugagcgcaaugauguggaucaguuacuuuguucaguccauuaggcuuuucaugcggacaggaucuugguggagcuuuaacccggaaacuaauugccuguugaacgugcccuucgguggcaccacagucgugcgcccucucguagaggacuccaccucaguuacugccguggucacaaaugggcaccugaagauggcuggaaugcauuuuggcgcaugugauuaugaccgacugccaaacgaagugaccguggccaaacccaauguccucaucgcuuuaaagaugguuaaacgucaaaguuacgguacgaacagcgggguggccauauaucacagauacaaggcgggaaauuacaggucuccuccaauuacugcagauaucgagcuggcccuuuugcgggcuuga

SEQ ID NO: 719 - RNA, 660 nt, Artificial Sequence
  derived and/or modified CDS sequence (opt3) from MERS-CoV__AGV08396__M
augagcaacaugacccagcugacagaggcccaaaucauugcuauaaucaaggacuggaauuucgcauggucccucauuuuucuucugaucacuauuguguugcaguacggcuaucccucuagaucaaugacggucuacguuuucaaaauguuuguguuauggcugcuauggccuaguagcauggcccucuccaucuucucugcgauauauccaaucgaucuggcuucgcagauuaucucagggauuguagccgcagugagcgccaugauguggaucaguuacuuuguccaguccauaaggcuuuucaugcggaccggaucuugguggagcuuuaacccggaaacaaauugccuguugaacgugcccuucgguggcacuaccguugugcgcccucucgucgaggacuccacaucagugaccgcuguaguuacuaaugggcaccugaagauggcaggaaugcauuuuggcgccugugauuaugaccgacugccaaacgaagugacagucgcuaaacccaaugugcucauugccuuaaagauggugaaacgucaaaguuacgguaccaacagcggggucgcgaucuaucacagauacaaggcaggaaauuacaggucuccuccaauuacggccgauaucgagcuggcucuuuugcgggccuga

SEQ ID NO: 720 - RNA, 660 nt, Artificial Sequence
  derived and/or modified CDS sequence (opt3) from MERS-CoV__AGV08590__M
augagcaacaugacccagcugacagaggcccaaaucauugcuauaaucaaggacuggaauuucguguggucccucauuuuucuucugaucacuauugucuugcaguacggcuaucccucuagaucaaugacgguuuacguguucaaaauguuuguauuauggcugcuauggccuaguagcauggcacucuccaucuucucugccguguauccaauagaucuggcgucgcagaucauuucagggaucgucgcugccgugagcgcaaugauguggauuaguuacuuuguucaguccaucaggcuuuucaugcggaccggaucuugguggagcuuuaacccggaaacaaauugccuguugaacgugcccuucgguggcacuaccgucgugcgcccucucguagaggacuccacaucaguuaccgccguggucacuaaugggcaccugaagauggcuggaaugcauuuuggcgcaugugauuaugaccgacugccaaacgaagugacaguggccaaacccaauguccucauagcuuuaaagaugguuaaacgucaaaguuacgguaccaacagcgggguggccauuuaucacagauacaaggcgggaaauuacaggucuccuccaaucacggcagauauugagcuggcccuuuugcgggcuuga

SEQ ID NO: 721 - RNA, 660 nt, Artificial Sequence
  derived and/or modified CDS sequence (opt3) from MERS-CoV__AHI48567__M
augagcaacaugacccagcuggccgaggcucaaaucauugcaauaaucaaggacuggaauuucgccuggucccucauuuuucuucugaucacaauuguguugcaguacggcuaucccucuagaucaaugacugucuacguuuucaaaauguuuguguuauggcugcuauggccuaguagcauggcgcucuccaucuucucugcuguauauccaauagaucuggccucgcagaucauuucagggaucguggcagccgucagcgcuaugauguggauuaguuacuuugugcaguccaucaggcuuuucaugcggacgggaucuugguggagcuuuaacccggaaaccaauugccuguugaacguucccuucgguggcacaacugugguccgcccucucguggaggacuccaccucaguaacagcaguugugaccaaugggcaccugaagauggccggaaugcauuuuggcgcuugugauuaugaccgacugccaaacgaagucacuguggccaaacccaaugugcucauagcguuaaagauggucaaacgucaaaguuacgguacaaacagcgggguugcaauuuaucacagauacaaggccggaaauuacaggucuccuccaaucaccgcugauauugagcuggcccuuuugcgggcauga

SEQ ID NO: 722 - RNA, 660 nt, Artificial Sequence
  derived and/or modified CDS sequence (opt3) from MERS-CoV__AHI48589__M
augagcaacaugacccagcugacagaggcccaaaucauugcugugauaaaggacuggaauuucgcauggucccucaucuuucuucugauuacuaucgucuugcaguacggcuaucccucuagaucaaugacgguuuacguguucaaaauguuuguauuauggcugcuauggccuaguagcauggcccucuccauuuucucugcgaucuauccaauagaucuggcuucgcagaucauuucagggaucguggccgcagucagcgccaugauguggauuaguuacuuugugcaguccaucaggcuuuucaugcggaccggaucuugguggagcuuuaacccggaaacaaauugccuguugaacguucccuucgguggcacuaccgugguccgcccucucguggaggacuccacaucaguaaccgcuguugugacuaaugggcaccugaagauggcaggaaugcauuuuggcgccugugauuaugaccgacugccaaacgaagucacaguggcuaaacccaaugugcucauagccuuaaagauggucaaacgucaaaguuacgguaccaacagcgggguugcgauuuaucacagauacaaggcaggaaauuacaggucuccuccaaucacggccgauauugagcuggcucuuuugcgggccuga

SEQ ID NO: 723 - RNA, 660 nt, Artificial Sequence
  derived and/or modified CDS sequence (opt3) from MERS-CoV__AIL23940__M
augagcaacaugacccagcugacagaggcccaaaucauugcuauaaucaaggacuggaauuucgcauggucccucauuuuucuucugaucacuauuguguugcaguacggcuaucccucuagaucaaugacggucuacguuuucaaaauguuuguguuauggcugcuauggccuaguagcauggcccucuccaucuucucugcgauauauccaaucgaucuggcuucgcagauuaucucagggauuguagccgcagugagcgccaugauguggaucaguuacuuuguccaguccauaaggcuuuucaugcggaccggaucuugguggagcuuuaacccggaaacaaauugccuguugaacgugcccuucgguggcacuaccguugugcgcccucucgucgaggacuccacaucagugaccgcuguaguuacuaaugggcaccugaagauggcaggaaugcauuuuggcgccugugauuaugaccgacugccaaacgaagugacagucgcuaaacccaauguggugauugcccucaagauggucaaacgucaaaguuacgguaccaacagcgggguugcgaucuaucacagauacaaggcaggaaauuacaggucuccuccaauuacggccgauaucgaguuagcucugcuucgggccuga

SEQ ID NO: 724 - RNA, 660 nt, Artificial Sequence
  derived and/or modified CDS sequence (opt3) from MERS-CoV__AKM76245__M
augagcaacaucacccagcugacagaggcccaaauuauagcuaucauuaaggacuggaauuucgcauggucccucaucuuucuucugauuacuaucguguugcaguacggcuaucccucuagaucaaugacggucuacguuuucaaaauguuuguguuauggcugcuauggccuaguagcauggcccucuccauauucucugcgguauauccaaucgaucuggcuucgcagauuaucucagggauuguggccgcagucagcgccaugauguggaucaguuacuuugugcaguccauaaggcuuuucaugcggaccggaucuugguggagcuuuaacccggaaacaaauugccuguugaacguucccuucgguggcacuaccgugguccgcccucucguggaggacuccacaucaguaaccgcuguugugacuaaugggcaccugaagauggcaggaaugcauuuuggcgccugugauuaugaccgacugccaaacgaagucacaguggcuaaacccaaugugcucauugccuuaaagauggucaaacgucaaaguuacgguaccaacagcgggguugcgaucuaucacagauacaaggcaggaaauuacaggucuccuccaauuacggccgauaucgagcuggcucuuuugcgggccuga

SEQ ID NO: 725 - RNA, 660 nt, Artificial Sequence
  derived and/or modified CDS sequence (opt3) from MERS-CoV__ALW82726__M
augagcaacaugacccagcugacagaggcccaaaucauugcuauaaucaaggacuggcacuucgcauggucccucauuuuucuucugaucacuauuguguugcaguacggcuaucccucuagaucaaugacggucuacguuuucaaaauguuuguguuauggcugcuauggccuaguagcauggcccucuccaucuucucugcgauauauccaaucgaucuggcuucgcagauuaucucagggauuguagccgcagugagcgccaugauguggaucaguuacuuuguccaguccauaaggcuuuucaugcggaccggaucuugguggagcuuuaauccggaaacaaacugccuguugaaugugcccauugguggcacuaccguugugcgcccucucgucgaggacuccacaucagugaccgcuguaguuacuaacgggcaucugaagauggcaggaaugcacuucggcgccugugauuaugaccgacugccaaaugaagugacagucgcuaaacccaacgugcucaucgccuuaaagauggugaaacgucaaaguuacgguaccaauagcggggucgcgauuuaucauagauacaaggcaggaaacuacaggucuccuccaaucacggccgauaucgagcuggcucuuuugcgggccuga

SEQ ID NO: 726 - RNA, 660 nt, Artificial Sequence
  derived and/or modified CDS sequence (opt3) from MERS-CoV__ALX27238__M
augagcaacaugacccagcugacagaggcccaaaucauugcuauaaucaaggacugguccuucgcauggucucucauuuuucuucugaucacuauuguguugcaguacggcuaucccucaagaaguaugacggucuacguuuucaaaauguuuguguuauggcugcuauggccuagcuccauggcccucucuaucuucucggcgguauauccaauagaucuggcuucacagaucauuagcgggaucguggccgcagucagugccaugauguggauuuccuacuuugugcagucuaucaggcuuuucaugcggaccggaagcuggugguccuuuaauccggaaacaaacugccuguugaauguucccuucgguggcacuaccgugguccgcccucucguggaggacucaacaaguguaaccgcuguugugacuaacgggcaccugaagauggcaggaaugcauuuuggcgccugugauuaugaccgacugccaaaugaagucacaguggcuaaacccaacgugcucauagccuuaaagauggucaaacgucaaagcuacgguaccaauucugggguugcgauuuaucacagauacaaggcaggaaacuacagguccccuccaaucacggccgauauugagcuggcucuuuugcgggccuga

SEQ ID NO: 727 - RNA, 660 nt, Artificial Sequence
  derived and/or modified CDS sequence (opt3) from MERS-CoV__AMQ49021__M
augagcaacaugacccagcugacagaggcccaaaucauugcuauaaucaaggacuggcacuucgcauggucccucauuuuucuucugaucacuauuguguugcaguacggcuaucccucuagaucaaugacggucuacguuuucaaaauguuuguguuauggcugcuauggccuaguagcauggcccucuccaucuucucugcgauauauccaaucgaucuggcuucgcagauuaucucagggauuguagccgcagugagcgccaugauguggaucaguuacuuuguccaguccauaaggcuuuucaugcggaccggaucuugguggagcuuuaauccggaaacaaacugccuguugaaugugcccauugguggcacuaccguugugcgcccucucgucgaggacuccacaucagugaccgcuguaguuacuaacgggcaucugaagauggcaggaaugcacuucggcgccugugauuaugaccgacugaguaaugaagugacagucgcuaaaccaaacgugcucaucgccuuaaagauggugaaacgucaaagcuacgguaccaauucuggggucgcgauuuaucauagauacaaggcaggaaacuacagguccccucccaucacggccgauaucgagcuggcucuuuugcgggccuga

SEQ ID NO: 728 - RNA, 660 nt, Artificial Sequence
  derived and/or modified CDS sequence (opt3) from MERS-CoV__AJG44108__M
augagcaacaugacccagcugacagaggcccaaaucauugcuauaaucaaggacuggaauuucgcauggucccucauuuuucuucugaucacuauuguguugcaguacggcuaucccucuagaucaaugacggucuacguuuucaaaauguuuguguuauggcugcuauggccuaguagcauggcccucuccaucuucucugcguuuuauccaauagaucuggcuucgcagaucauuucagggaucguagccgcagugagcgccaugauguggauuaguuacuucguccaguccaucaggcuuuuuaugcggaccggaucuugguggagcuucaacccggaaacaaauugccuguugaacgugcccuuugguggcacuaccguugugcgcccucucgucgaggacuccacaucagugaccgcuguaguuacuaaugggcaccugaagauggcaggaaugcauuucggcgccugugauuaugaccgacugccaaacgaagugacagucgcuaaacccaaugugcucauagccuuaaagauggugaaacgucaaaguuacgguaccaacagcggggucgcgauuuaucacagauacaaggcaggaaauuacaggucuccuccaaucacggccgauauugagcuggcucuuuugcgggccuga

SEQ ID NO: 729 - RNA, 660 nt, Artificial Sequence
  derived and/or modified CDS sequence (opt3) from MERS-CoV__ALA49369__M
augagcaacaugacccagcugacagaggcccaaaucauugcuauaaucaaggacuggaauuucgcauggucccucauuuuucuucugaucacuauuguguugcaguacggcuaucccucuagaucaaugacggucuacguuuucaaaauguuuguguuauggcugcuauggccuaguagcauggcccucuccaucuucucugcgauauauccaaucgaucuggcuucgcagauuaucucagggauuguagccgcagugagcgccaugauguggaucaguuacuuuguccaguccauaaggcuuuucaugcggaccggaucuugguggagcuuuaacccggaaacaaauugccuguugaacgugcccauugguggcacuaccguugugcgcccucucgucgaggacuccacaucagugaccgcuguaguuacuaaugggcaccugaagauggcaggaaugcauuucggcgccugugauuaugaccgacugccaaacgaagugacagucgcuaaacccaaugugcucaucgccuuaaagauggugaaacgucaaaguuacgguaccaacagcggggucgcgauuuaucacagauacaaggcaggaaauuacaggucuccuccaaucacggccgauaucgagcuggcucuuuugcgggccuga

SEQ ID NO: 730 - RNA, 660 nt, Artificial Sequence
  derived and/or modified CDS sequence (opt3) from MERS-CoV__ALA49424__M
augagcaacaugacccagcugacagaggcccaaaucauugcuauaaucaaggacuggaauuucgcauggucccucauuuuucuucugaucacuauuguguugcaguacggcuaucccucuagaucaaugacggucuacguuuucaaaauguuuguguuauggcugcuauggccuaguagcauggcccucuccaucuucucugcgauauauccaaucgaucuggcuucgcagauuaucucagggauuguagccgcagugagcgccaugaugaggaucaguuacuuuguccaguccauacggcuuuucaugcgcaccggaucuugguggagcuuuaacccggaaacaaauugccuguugaacgugcccuucgguggcacuaccguugugcgaccucucgucgaggacuccacaucagugaccgcuguaguuacuaaugggcaccugaagauggcaggaaugcauuuuggcgccugugauuaugaccgucugccaaacgaagugacagucgcuaaacccaaugugcucauugccuuaaagauggugaaaagacaaaguuacgguaccaacagcggggucgcgaucuaucacagguacaaggcaggaaauuaccggucuccuccaauuacggccgauaucgagcuggcucuuuugcgcgccuga

SEQ ID NO: 731 - RNA, 660 nt, Artificial Sequence
  derived and/or modified CDS sequence (opt3) from MERS-CoV__ALA49908__M
augagcaacaugacccagcugacagaggcccaaaucauugcuauaaucaaggacuggaauuucgcauggucccucauuuuucuucugaucacuauuguguugcaguacggcuaucccucuagaucaaugacggucuacguuuucaaaauguuuguguuauggcugcuauggccuaguagcauggcccucuccaucuucucugcgauauauccaaucgaucugucgucacagauuaucagcgggauuguagcugccgugagugcaaugauguggaucuccuacuuuguccagucuauaaggcuuuucaugcggaccggaagcuggugguccuuuaacccggaaacaaauugccuguugaacgugcccuucgguggcacuaccguugugcgcccucucgucgaggacucaacaagugugaccgccguaguuacuaaugggcaccugaagauggcuggaaugcauuuuggcgcaugugauuaugaccgacugccaaacgaagugacagucgccaaacccaaugugcucauugcuuuaaagauggugaaacgucaaagcuacgguaccaacucuggggucgccaucuaucacagauacaaggcgggaaauuacagguccccuccaauuacggcagauaucgagcuggcccuuuugcgggcuuga

SEQ ID NO: 732 - RNA, 660 nt, Artificial Sequence
  derived and/or modified CDS sequence (opt3) from MERS-CoV__ALA49963__M
augagcaacaugacccagcugacagaggcccaaaucauugcuauaaucaaggacuggaauuucgcauggucccucauuuuucuucugaucacuauuguguugcaguacggcuaucccucuagaucaaugacggucuacguuuucaaaauguuuguguuauggcugcuauggccuaguagcauggcccucuccaucuucucugcgauauauccaaucgaucuggcuucgcagauuaucucagggauuguagccgcagugagcgccaugauguggaucaguuacuuuguccaguccauaaggcuuuucaugcggaccggaucuugguggagcuuuaacccggaaacaaauugccuguugaacgugcccauugguggcacuaccguugugcgcccucucgucgaggacuccacaucagugaccgcuguaguuacuaaugggcaccugaagauggcaggaaugcauuucggcgccugugauuaugaccgacugaguaacgaagugacagucgcuaaaccaaaugugcucaucgccuuaaagauggugaaacgucaaagcuacgguaccaacucuggggucgcgauuuaucacagauacaaggcaggaaauuacagguccccucccaucacggccgauaucgagcuggcucuuuugcgggccuga

SEQ ID NO: 733 - RNA, 1242 nt, Artificial Sequence
  derived and/or modified CDS sequence (opt3) from MERS-CoV__AFS88943__N
auggccagccccgcugcaccuagagccguguccuucgcggacaacaaugauaucaccaacacaaaucugucuaggggccgggggcgcaacccaaagccgcgagcugcccccaauaacacugucucaugguacacgggacucacccagcacgguaaaguuccucuuacauuuccacccggccaaggggugccucugaaugcaaacaguacuccagcccagaaugcuggauauuggcguagacaggacaggaagauuaacaccggcaaugguauaaaacaguuggcaccccggugguacuucuauuacacagggaccggaccugaggccgcuuuaccauuucgcgccguaaaggauggcaucguguggguccaugaagacggcgcgacugaugcaccgagcacauucgggaccagaaaccccaauaacgacuccgccauugugacgcaauuugcuccuggaacuaaacugccaaagaauuuccacaucgaggguaccggcgggaacucucagucgucaagcagggccaguucccuaucucggaacagcucccgcucaaguagccagggaucucgauccggcaauucaacaagagguacuagccccgggccuaguggaauuggcgcaguuggcggggaucuccuguaucuugaccuguugaacaggcuccaggcucuggaaucuggaaaggugaaacaaucccagccaaaggucaucaccaaaaaggaugccgcggccgcaaagaauaagaugcggcauaagcguacaagcaccaaaucguuuaacauggugcaggcuuucggucugcgcggccccggggaccuccagggaaauuuuggcgauuuacaacugaacaaacuugguacggaggacccgagauggccucagauagccgaauuggcucccacugccucugcauucauggggaugucccaguuuaaacugacacaccaaaauaacgaugaccauggcaauccaguauacuuccuaagguauucaggagccaucaagcucgacccuaaaaaccccaauuacaacaaguggcuggagcuucuggagcagaauauugaugcuuacaaaaccuuuccaaagaaggagaaaaagcagaaagcgcccaaggaagaaaguacugaccagaugagcgagccuccaaaagagcaacggguucagggcuccaucacacagcgaacccgcacgagaccgucugugcagcccgggccuaugauugaugucaacaccgacuga

SEQ ID NO: 734 - RNA, 1236 nt, Artificial Sequence
  derived and/or modified CDS sequence (opt3) from MERS-CoV__AFY13314__N
auggccagccccgcugcaccuagagccguguccuucgcggacaacaaugauaucaccaacacaaaucugucuaggggccgggggcgcaacccaaagccgcgagcugcccccaauaacacugucucaugguacacgggacucacccagcacgguaaaguuccucuuacauuuccacccggccaaggggugccucugaaugcaaacaguacuccagcccagaaugcuggauauuggcguagacaggacaggaagauuaacaccggcaaugguauaaaacaguuggcaccccggugguacuucuauuacacagggaccggaccugaggccgcuuuaccauuucgcgccguaaaggauggcaucguguggguccaugaagacggcgcgacugaugcaccgagcacauucgggaccagaaaccccaauaacgacuccgccauugugacgcaauuugcuccuggaacuaaacugccaaagaauuuccacaucgaggguaccggcgggaacucucagucgucaagcagggccaguuccguuucucggaacagcucccgcucaaguagccagggaucucgauccggcaauucaacaagagguacuagccccgggccuaguggaauuggcgcagugggcggggaucuacucuaucuggaccuucugaacagguugcaggcucucgaaucuggaaaggucaaacaaucccagccaaaggugaucaccaaaaaggaugccgcggccgcuaaaaauaagaugcggcauaagcguacaagcaccaaaucguuuaacaugguacaggcauucggucugcgcggccccggggaccugcagggaaauuuuggcgaucuccaauuaaacaagcuggguacggaggacccgagauggccucagauagccgaacuugcucccacugccucugcauucauggggaugucccaguuuaaauugacacaccaaaauaacgaugaccauggcaauccaguuuacuuccugagguauucaggagccaucaagcuagacccuaaaaaccccaauuacaacaaguggcucgagcugcuugagcagaauauugaugcuuacaaaaccuuuccaaagaaggagaaaaagcagaaagcgcccaaggaagaaaguacugaccagaugagcgagccuccaaaagagcaccgggugcaaggcacacagcgaacccgcacgagaccguccguccagcccgggccuaugaucgaugugaacaccgacuga

SEQ ID NO: 735 - RNA, 1242 nt, Artificial Sequence
  derived and/or modified CDS sequence (opt3) from MERS-CoV__AGH58724__N
auggccagccccgcugcaccuagagccguguccuucgcguacaacaaugacaucaccaacacaaaucugucuaggggccgggggcgcaacccaaagccgcgagcugcccccaauaacacugucucaugguauacgggacucacccagcacgguaaaguuccucuuacauuuccacccggccaaggggugccucugaaugcaaacaguacuccagcccagaaugcuggauacuggcguagacaggauaggaagauuaacaccggcaaugguauaaaacaguuggcaccccggugguauuucuacuauacagggaccggaccugaggccgcuuuaccauuucgcgccguaaaggacggcaucguguggguccaugaagauggcgcgacugacgcaccgagcacauucgggaccagaaaccccaauaacgauuccgccauugugacgcaauuugcuccuggaacuaaacugccaaagaauuuccacaucgaggguaccggcgggaacucucagucgucaagcagggccaguuccguuucucggaacagcucccgcucaaguagccagggaucucgauccggcaauucaacaagagguacuagccccgggccuaguggaauuggcgcagugggcggggaccuacucuaccuggaucuucugaacagguugcaggcucucgaaucuggaaaggucaaacaaucccagccaaaggugaucaccaaaaaggacgccgcggccgcuaaaaauaagaugcggcauaagcguacaagcaccaaaucguuuaacaugguacaggcauucggucugcgcggccccggggaucugcagggaaauuuuggcgaccuccaauuaaacaagcuggguacggaggauccgagauggccucagauagccgaacuugcucccacugccucugcauucauggggaugucccaguuuaaauugacacaccaaaauaacgacgaucauggcaauccaguuuauuuccugagguacucaggagccaucaagcuagacccuaaaaaccccaauuacaacaaguggcucgagcugcuugagcagaauauugacgcuuauaaaaccuuuccaaagaaggagaaaaagcagaaagcgcccaaggaagaaaguacugaucagaugagcgagccuccaaaagagcaacgggugcagggcuccaucacacagcgaacccgcacgagaccgucuguccagcccgggccuaugauugacgugaacaccgauuga

SEQ ID NO: 736 - RNA, 1242 nt, Artificial Sequence
  derived and/or modified CDS sequence (opt3) from MERS-CoV__AGV08397__N
auggccagccccgcugcaccuagagccguguccuucgcggacaacaaugauaucaccaacacaaaucugucuaggggccgggggcgcaacccaaagccgcgagcugcccccaauaacacugucucaugguacacgggacucacccagcacgguaaaguuccucuuacauuuccacccggccaaggggugccucugaaugcaaacaguacuccagcccagaaugcuggauauuggcguagacaggacaggaagauuaacaccggcaaugguauaaaacaguuggcaccccggugguacuucuauuacacagggaccggaccugaggccgcuuuaccauuucgcgccguaaaggauggcaucguguggguccaugaagacggcgcgacugaugcaccgagcacauucgggaccagaaaccccaauaacgacuccgccauugugacgcaauuugcuccuggaacuaaacugccaaagaauuuccacaucgaggguaccggcgggaacucucagucgucaagcagggccaguuccguuucucggaacagcucccgcucaaguagccagggaucucgauccggcaauucaacaagagguacuagccccgggccuaguggaauuggcgcagugggcggggaucuacucuaucuggaccuucugaacagguugcaggcucucgaaucuggaaaggucaaacaaucccagccaaaggugaucaccaaaaaggaugccgcggccgcuaaaaauaagaugcggcauaagcguacaagcaccaaaucguuuaacaugguacaggcauucggucugcgcggccccggggaccugcagggaaauuuuggcgaucuccaauuaaacaagcuggguacggaggacccgagauggccucagauagccgaacuugcucccacugccucugcauucauggggaugucccaguuuaaauugacacaccaaaauaacgaugaccauggcaauccaguuuacuuccugagguauucaggagccaucaagcuagacccuaaaaaccccaauuacaacaaguggcucgagcugcuugagcagaauauugaugcuuacaaaaccuuuccaaagaaggagaaaaagcagaaagcgcccaaggaagaacugacugaccagaugagugagccuccaaaagagcaacgggugcagggcagcaucacacagcgaacccgcacgagaccguccguccagcccgggccuaugauugaugugaacaccgacuga

SEQ ID NO: 737 - RNA, 1242 nt, Artificial Sequence
  derived and/or modified CDS sequence (opt3) from MERS-CoV__AGV08415__N
auggccagccccgcugcaccuagagccguguccuucgcggacaacaaugauaucaccaacacaaaucugucuaggggccgggggcgcaacccaaagccgcgagcugcccccaauaacacugucucaugguacacgggacucacccagcacgguaaaguuccucuuacauuuccacccggccaaggggugccucugaaugcaaacaguacuccagcccagaaugcuggauauuggcguagacaggacaggaagauuaacaccggcaaugguauaaaacaguuggcaccccggugguacuucuauuacacagggaccggaccugaggccgcuuuaccauuucgcgccguaaaggauggcaucguguggguccaugaagacggcgcgacugaugcaccgagcacauucgggaccagaaaccccaauaacgacuccgccauugugacgcaauuugcuccuggaacuaaacugccaaagaauuuccacaucgaggguaccggcgggaacucucagucgucaagcagggccaguuccguuucucggaacagcucccgcucaaguagccagggaucucgauccggcaauucaacaagagguacuagccccgggccuaguggaauuggcgcagugggcggggaucuacucuaucuggaccuucugaacagguugcaggcucucgaaucuggaaaggucaaacaaucccagccaaaggugaucaccaaaaaggaugccgcggccgcuaaaaauaagaugcggcauaagcguacaagcaccaaaucguuuaacaugguacaggcauucggucugcgcggccccggggaccugcagggaaauuuuggcgaucuccaauuaaacaagcuggguacggaggacccgagauggccucagauagccgaacuugcucccacugccucugcauucauggggaugucccaguuuaaauugacacaccaaaauaacgaugaccauggcaauccaguuuacuuccugagguauucaggagccaucaagcuagacccuaaaaaccccaauuacaacaaguggcucgagcugcuugagcagaauauugaugcuuacaaaaccuuuccaaagaaggagaaaaagcagaaagcgcccaaggaagaaaguacugaccagaugagcgagccuccaaaagagcaacgggugcagggcuccaucacacagcgaacccgcacgagaccgucuguccagcccgggccuaugauugaugugaacaccgacuga

SEQ ID NO: 738 - RNA, 1242 nt, Artificial Sequence
  derived and/or modified CDS sequence (opt3) from MERS-CoV__AGV08487__N
auggccagccccgcugcaccuagagccguguccuucgcggacaacaaugauaucaccaacacaaaucugucuaggggccgggggcgcaacccaaagccgcgagcugcccccaauaacacugucucaugguacacgggacucacccagcacgguaaaguuccucuuacauuuccacccggccaaggggugccucugaaugcaaacaguacuccagcccagaaugcuggauauuggcguagacaggacaggaagauuaacaccggcaaugguauaaaacaguuggcaccccggugguacuucuauuacacagggaccggaccugaggccgcuuuaccauuucgcgccguaaaggauggcaucguguggguccaugaacacggcgcgacugacgcaccgagcacauucgggaccagaaaccccaauaacgauuccgccauugugacgcaauuugcuccuggaacuaaacugccaaagaauuuccauaucgaggguaccggcgggaacucucagucgucaagcagggccaguuccguuucucggaacagcucccgcucaaguagccagggaucucgauccggcaauucaacaagagguacuagccccgggccuaguggaauuggcgcagugggcggggaccuacucuaucuggaucuucugaacagguugcaggcucucgaaucuggaaaggucaaacaaucccagccaaaggugaucaccaaaaaggacgccgcggccgcuaaaaauaagaugcggcacaagcguacaagcaccaaaucguuuaacaugguacaggcauucggucugcgcggccccggggaucugcagggaaauuuuggcgaccuccaauuaaacaagcuggguacggaggauccgagauggccucagauagccgaacuugcucccacugccucugcauucauggggaugucccaguuuaaauugacacaucaaaauaacgacgaucacggcaauccaguuuacuuccugagguauucaggagccaucaagcuagacccuaaaaaccccaauuacaacaaguggcucgagcugcuugagcagaauauugacgcuuacaaaaccuuuccaaagaaggagaaaaagcagaaagcgcccaaggaagaaaguacugaucagaugagcgagccuccaaaagagcaacgggugcagggcuccaucacacagcgaacccgcacgagaccgucuguccagcccgggccuaugauugacgugaacaccgauuga

SEQ ID NO: 739 - RNA, 1242 nt, Artificial Sequence
  derived and/or modified CDS sequence (opt3) from MERS-CoV__AHC74095__N
auggccagccccgcugcaccuagagccguguccuucgcggacaacaaugauaucaccaacacaaaucugucuaggggccgggggcgcaacccaaagccgcgagcugcccccaauaacacugucucaugguacacgggacucacccagcacgguaaaguuccucuuacauuuccacccggccaaggggugccucugaaugcaaacaguacuccagcccagaaugcuggauauuggcguagacaggacaggaagauuaacaccggcaaugguauaaaacaguuggcaccccggugguacuucuauuacacagggaccggaccugaggccgcuuuaccauuucgcgccguaaaggauggcaucguguggguccaugaagacggcgcgacugaugcaccgagcacauucgggaccagaaaccccaauaacgaccuggccauugugacgcaauuugcuccuggaacuaaacuaccaaagaauuuccacaucgaggguaccggcgggaacucccagucuucgucaagggccagcaguguuucccggaacucuagccgcuccucaagucagggaagccgaucuggcaauuccacaagagguacuucacccgggccuagcggaauuggcgcagugggcggggaucuccuguaucuugaccuguugaacaggcuccaggcucuggaaaguggaaaggucaaacaaucucagccaaaggugaucaccaaaaaggaugccgcggccgcuaaaaauaagaugcggcauaagcguacauccaccaagagcuuuaacaugguacaggcauucggucugcgcggccccggggaccuccagggaaauuuuggcgauuuacaacugaacaaacuugguacggaggacccgagauggccucagauagccgaauuggcucccacugccucggcauucauggggaugucucaguuuaaacugacacaccaaaauaacgaugaccauggcaauccaguuuacuuccuaagguauuccggagccaucaagcucgacccuaaaaaccccaauuacaacaaguggcuggagcuucuggagcagaauauugaugcuuacaaaaccuuuccaaagaaggagaaaaagcagaaagcgcccaaggaagaaucaacugaccagaugagugagccuccaaaagagcaacgggugcagggcagcaucacacagcgaacccgcacgagaccguccguccagcccgggccuaugauugaugugaacaccgacuga

SEQ ID NO: 740 - RNA, 1242 nt, Artificial Sequence
  derived and/or modified CDS sequence (opt3) from MERS-CoV__AHI48535__N
auggccagccccgcugcaccuagagccguguccuucgcggacaacaaugauaucaccaacacaaaucugucuaggggccgggggcgcaacccaaagccgcgagcugcccccaauaacacugucucaugguacacgggacucacccagcacgguaaaguuccucuuacauuuaguccaggccaaggggugccccugaaugcaaacagcacuccugcccagaaugcuggauauuggcguagacaggacaggaagauuaacaccggcaaugguauaaaacaguuggcaccacggugguacuucuauuacacagggaccggacccgaggccgcuuuaccuuuucgcgccguaaaggauggcaucguguggguccaugaagacggcgcgacugaugcaccauccacauucgggaccagaaacccgaauaacgacucugccauugugacgcaauuugcucccggaacuaaacugccuaagaauuuccacaucgaggguaccggcgggaacucgcagucaagcaguagggccuccucuguuagccggaacuccucacgcaguagcucucagggaucccgaucaggcaauagcacaagagguaccaguccagggcccucuggaauuggcgcagugggcggggaucuacucuaucuggaccuucugaacagguugcaggcucucgaauccggaaaggucaaacaaagccagccuaaggugaucacuaaaaaggaugccgcggccgcuaaaaauaagaugcggcauaagcguacaucgaccaaaucuuuuaacaugguacaggcauucggucugcgcggcccaggggaccugcagggaaauuuuggcgaucuccaauuaaacaagcuggguacggaggaccccagauggccgcagauagccgaacuugcuccuacugccuccgcauucauggggaugucacaguuuaaauugacacaccaaaauaacgaugaccauggcaaucccguuuacuuccugagguauaguggagccaucaagcuagacccuaaaaacccaaauuacaacaaguggcucgagcugcuugagcagaauauugaugcuuacaaaaccuuucccaagaaggagaaaaagcagaaagcgccaaaggaagaaagcacugaccagguguccgagcccccuaaagagcaacggguccagggcaucauuacacagcgaacccgcacgagaccaucugugcagccggggcccaugaucgaugugaacaccgacuga

SEQ ID NO: 741 - RNA, 1242 nt, Artificial Sequence
  derived and/or modified CDS sequence (opt3) from MERS-CoV__AIL23941__N
auggccagccuggcugcacccagagccguguccuucgcggacaacaaugauaucaccaacacaaaucucucuaggggccgggggcgcaacccuaagccacgagcugccccgaauaacacugucucaugguacacgggacuuacccagcacgguaaaguuccccugacauuuccuccaggccaaggggugcccuugaaugcaaacaguacuccugcccagaaugcuggauauuggcguagacaggacaggaagauuaacaccggcaaugguauaaaacaguuagcaccacggugguacuucuauuacacagggaccggacccgaggccgcucugccuuuucgcgccguaaaggauggcaucguguggguccaugaacacggcgcgacugacgcaccaagcacauucgggaccagaaacccgaauaacgauuccgccauugugacgcaauuugcucccggaacuaaacuaccuaagaauuuccauaucgaggguaccggcgggaacucucagucgucaagcagggccaguuccguuucucggaacagcucccgcucaaguagccagggaucucgauccggcaauucaacaagagguacuagcccagggcccaguggaauuggcgcagugggcggggaccuccuguaucuugaucuguugaacaggcuccaggcucuggaaucuggaaaggucaaacaaucccagccuaaggugaucaccaaaaaggacgccgcggccgcaaagaauaagaugcggcacaagcguacaagcaccaaaucguuuaacaugguacaggcuuucggucugcgcggcccaggggaucuccagggaaauuuuggcgacuuacaacugaacaaacuugguacggaggaucccagauggccgcagauagccgaauuggcuccuacugccucugcauucauggggaugucccaguuuaaacugacacaucaaaauaacgacgaucacggcaaucccguuuacuuccuaagguauucaggagccaucaagcucgacccuaaaaacccaaauuacaacaaguggcuggagcuucuggagcagaauauugacgcuuacaaaaccuuucccaagaaggagaaaaagcagaaagcgccaaaggaagaaaguacugaucagaugagcgagcccccuaaagagcaacgggugcagggcuccaucacacagcgaacccgcacgagaccaucuguccagccggggcccaugauugacgugaacaccgauuga

SEQ ID NO: 742 - RNA, 1242 nt, Artificial Sequence
  derived and/or modified CDS sequence (opt3) from MERS-CoV__AIL23996__N
auggccagccccgcugcaccuagagccguguccuucgcggacaacaaugauaucaccaacacaaaucugucuaggggccgggggcgcaacccaaagccgcgagcugcccccaauaacacugucucaugguacacgggacucacccagcacgguaaaguuccucuuacauuuccacccggccaaggggugccucugaaugcaaacaguacuccagcccagaaugcuggauauuggcguagacaggacaggaagauuaacaccggcaaugguauaaaacaguuggcaccccggugguacuucuauuacacagggaccggaccugaggccgcuuuaccauuucgcgccguaaaggauggcaucguguggguccaugaagacggcgcgacugaugcaccgagcacauucgggaccagaaaccccaauaacgaccuggccauugugacgcaauuugcuccuggaacuaaacuaccaaagaauuuccacaucgaggguaccggcgggaacucccagucuucgucaagggccagcaguguuucccggaacucuagccgcuccucaagucagggaagccgaucuggcaauuccacaagagguacuucacccgggccuagcggaauuggcgcagugggcggggaucuccuguaucuugaccuguugaacaggcuccaggcucuggaaaguggaaaggucaaacaaucucagccaaaggugaucaccaaaaaggaugccgcggccgcuaaaaauaagaugcggcauaagcguacauccaccaagagcuuuaacaugguacaggcauucggucugcgcggccccggggaccuccagggaaauuuuggcgauuuacaacugaacaaacuugguacggaggacccgagauggccucagauagccgaauuggcucccacugccucggcauucauggggaugucucaguuuaaacugacacaccaaaauaacgaugaccauggcaauccaguuuacuuccuaagguauuccggagccaucaagcucgacccuaaaaaccccaauuacaacaaguggcuggagcuucuggagcagaauauugaugcuuacaaaaccuuuccaaagaaggagaaaaagcagaaagcgcccaaggaagaaucaacugaccagaugagugagccuccaaaagagcaacgggugcagggcagcaucacacagcacacccgaacgcgcccguccguccagcccgggccuaugauugaugugaacaccgacuga

SEQ ID NO: 743 - RNA, 1242 nt, Artificial Sequence
  derived and/or modified CDS sequence (opt3) from MERS-CoV__AIY60565__N
auggccgcucccgcagccccuagagcggugagcuucgcugacaacaaugauaucaccaacacaaaucuguccaggggccgggggcgcaacccaaagccgcgagccgcacccaauaacacugucucuugguacacgggacucacccagcacgguaaaguuccucuuacauuuccacccggccaaggggugccucugaaugccaacucaacuccagcucagaaugcaggauauuggcguagacaggacaggaagauuaacaccggcaaugguauaaaacaguuggcuccccggugguacuucuauuacacagggaccggaccugaggccgccuuaccauuucgcgcgguaaaggauggcaucguguggguccaugaagacggcgcaacugaugccccgaguacauucgggaccagaaaccccaauaacgacagcgcuauugugacgcaauuugccccuggaacuaaacugccaaagaauuuccacaucgaggguaccggcgggaacucccagucuucgucaagggcaagcaguguuucccggaacucuagccgcuccucaagucagggaagccgaucuggcaauuccacaagagguacuucacccgugccuagcgggauuggagcugucggcggcgaucuacucuaucuggaccuucugaacagguugcaggcccucgaaagugggaaggugaaacaaucucagccaaagguaaucaccaaaaaggaugcggccgcagcuaaaaauaagaugcggcauaagcguacauccaccaagagcuuuaacaugguucaggccuucggacugcgcggucccggcgaccugcaggggaauuuuggagaucuccaauuaaacaaacugggcacggaggacccgagauggccucagauagcugaacuugcccccacugcaucggccuucauggguaugucucaguuuaaauugacacaccaaaauaacgaugaccaugggaauccaguguacuuccugagguauuccggcgcuaucaagcuagacccuaaaaaccccaauuacaacaaguggcucgagcugcuugagcagaauauugaugcguacaaaaccuuuccaaagaaggagaaaaagcagaaagcacccaaggaagaaucaacugaccagaugagugagccuccaaaagagcaacggguccagggaagcaucacacagcgaacccgcacgagaccguccgugcagcccggcccuaugauugaugugaacaccgacuga

SEQ ID NO: 744 - RNA, 1242 nt, Artificial Sequence
  derived and/or modified CDS sequence (opt3) from MERS-CoV__AIZ74424__N
auggccgcucccgcagccccuagagcggugagcuucgcugacaacaaugauaucaccaacacaaaucuguccaggggccgggggcgcaacccaaagccgcgagccgcacccaauaacacugucucuugguacacgggacucacccagcacgguaaaguuccucuuacauuuccacccggccaaggggugccucugaaugccaacucaacuccagcucagaaugcaggauauuggcguagacaggacaggaagauuaacaccggcaaugguauaaaacaguuggcuccccggugguacuucuauuacacagggaccggaccugaggccgccuuaccauuucgcgcgguaaaggauggcaucguguggguccaugaagacggcgcaacugaugccccgaguacauucgggaccagaaaccccaauaacgacagcgcuauugugacgcaauuugccccuggaacuaaacugccaaagaauuuccacaucgaggguaccggcgggaacucccagucuucgucaagggcaagcaguguuucccggaacucuagccgcuccucaagucagggaagccgaucuggcaauuccacaagagguacuucacccgggccuagcggaauuggcgcugugggcggggaucuacucuaucuggaccuucugaacagguugcaggcccucgaaaguggaaaggucaaacaaucucagccaaaggugaucaccaaaaaggaugcggccgcagcuaaaaauaagaugcggcauaagcguacauccaccaagagcuuuaacaugguacaggccuucggucugcgcggccccggggaccugcagggaaauuuuggcgaucuccaauuaaacaaacuggguacggaggacccgagauggccucagauagcugaacuugcccccacugcaucggccuucauggggaugucucaguuuaaauugacacaccaaaauaacgaugaccauggcaauccaguuuacuuccugagguauuccggagcuaucaagcuagacccuaaaaaccccaauuacaacaaguggcucgagcugcuugagcagaauauugaugcguacaaaaccuuuccaaagaaggagaaaaagcagaaagcacccaaggaagaaucaacugaccagaugagugagccuccaaaagagcaacgggugcagggcagcaucacacagcgaacccgcacgagaccguccguccagcccgggccuaugauugaugugaacaccgacuga

SEQ ID NO: 745 - RNA, 1242 nt, Artificial Sequence; identical to SEQ ID NO: 744
  derived and/or modified CDS sequence (opt3) from MERS-CoV__AIZ74430__N

SEQ ID NO: 746 - RNA, 1242 nt, Artificial Sequence
  derived and/or modified CDS sequence (opt3) from MERS-CoV__AKI29291__N
auggccagccccgcugcaccuagagccguguccuucgcggacaacaaugauaucaccaacacaaaucugucuaggggccgggggcgcaacccaaagccgcgagcugcccccaauaacacugucucaugguacacgggacucacccagcacgguaaaguuccucuuacauuuccacccggccaaggggugccucugaaugcaaacaguacuccagcccagaaugcuggauauuggcguagacaggacaggaagauuaacaccggcaaugguauaaaacaguuggcaccccggugguacuucuauuacacagggaccggaccugaggccgcuuuaccauuucgcgccguaaaggauggcaucguguggguccaugaagacggcgcgacugaugcaccgagcacauucgggaccagaaaccccaauaacgacuccgccauugugacgcaauuugcuccuggaacuaaacugccaaagaauuuccacaucgaggguaccggcgggaacucucagucgucaagcagggccaguuccguuucucggaacagcucccgcucaaguagccagggaucucgauccggcaauucaacaagagguacuagccccgggccuaguggaauuggcgcagugggcggggaucuacucuaucuggaccuucugaacagguugcaggcucucgaaucuggaaaggucaaacaaucccagccaaaggugaucaccaaaaaggaugccgcggccgcuaaaaauaagaugcggcauaagcguacaagcaccaaaucguuuaacaugguacaggcauucggucugcgcggccccggggaccugcagggaaauuuuggcgaucuccaauuaaacaagcuggguacggaggacccgagauggccucagauagccgaacuugcucccacugccucugcauucauggggaugucccaguuuaaauugacacaccaaaauaacgaugaccauggcaauccaguuuacuuccugagguauucaggagccaucaagcuagacccuaaaaaccccaauuacaacaaguggcucgagcugcuugagcagaauauugaugcuuacaaaaccuuuccaaagaaggagaaaaagcagaaagcgcccaaggaagaaaguacugaccagaugagcgagccuccaaaagagcaacgggugcagggcuccaucacacagcgcauucgaaccagaccgucuguccagcccgggccuaugaucgaugugaacacggacuga

SEQ ID NO: 747 - RNA, 1242 nt, Artificial Sequence
  derived and/or modified CDS sequence (opt3) from MERS-CoV__AKK52599__N
auggccagccccgcugcaccuugcgccguguccuucgcggacaacaaugauaucaccaacacaaaucugucuagaggcagggggcggaacccaaagccgcgcgcugcccccaauaacacugucucaugguacacgggacucacccagcacgguaaaguuccucuuacauuuccacccggccaaggggugccucugaaugcaaacaguacuccagcccagaaugcuggauauuggcgacgucaggacagaaagauuaacaccggcaaugguauaaaacaguuggcacccaggugguacuucuauuacacagggaccggaccugaggccgcuuuaccauuucgggccguaaaggauggcaucguguggguccaugaagacggcgcgacugaugcaccgagcacauucgggacccgcaaccccaauaacgacuccgccauugugacgcaauuugcuccuggaacuaaacugccaaagaauuuccacaucgaggguaccggcgggaacucucagucgucaagcagagccaguuccguuucuaggaacagcucccggucaaguagccagggaucucgcuccggcaauucaacacgagguacuagccccgggccuaguggaauuggcgcagugggcggggaucuacucuaucuggaccuucugaacagauugcaggcucucgaaucuggaaaggucaaacaaucccagccaaaggugaucaccaaaaaggaugccgcggccgcuaaaaauaagaugaggcauaagcggacaagcaccaaaucguuuaacaugguacaggcauucggucugcguggccccggggaccugcagggaaauuuuggcgaucuccaauuaaacaagcuggguacggaggacccgcgcuggccucagauagccgaacuugcucccacugccucugcauucauggggaugucccaguuuaaauugacacaccaaaauaacgaugaccauggcaauccaguuuacuuccugagauauucaggagccaucaagcuagacccuaaaaaccccaauuacaacaaguggcucgagcugcuugagcagaauauugaugcuuacaaaaccuuuccaaagaaggagaaaaagcagaaagcgcccaaggaagaaaguacugaccagaugagcgagccuccaaaagagcaaagggugcagggcuccaucacacagcggacccgaacgcgcccgucuguccagcccgggccuaugauugaugugaacaccgacuga

SEQ ID NO: 748 - RNA, 1242 nt, Artificial Sequence
  derived and/or modified CDS sequence (opt3) from MERS-CoV__AKN24774__N
auggccagccccgcugcaccuagagccguguccuucgcggacaacaaugauaucaccaacacaaaucugucuaggggccgggggcgcaacccaaagccgcgagcugcccccaauaacacugucucaugguacacgggacucacccagcacgguaaaguuccucuuacauuuccacccggccaaggggugccucugaaugcaaacaguacuccagcccagaaugcuggauauuggcguagacaggacaggaagauuaacaccggcaaugguauaaaacaguuggcaccccggugguacuucuauuacacagggaccggaccugaggccgcuuuaccauuucgcgccguaaaggauggcaucguguggguccaugaagacggcgcgacugaugcaccgagcacauucgggaccagaaaccccaauaacgaccuggccauugugacgcaauuugcuccuggaacuaaacuaccaaagaauuuccacaucgaggguaccggcgggaacucccagucuucgucaagggccagcaguguuucccggaacucuagccgcuccucaagucagggaagccgaucuggcaauuccacaagagguacuucacccgggccuagcggaauuggcgcagugggcggggaucuccuguaucuugaccuguugaacaggcuccaggcucuggaaaguggaaaggucaaacaaucucagccaaaggugaucaccaaaaaggaugccgcggccgcuaaaaauaagaugcggcauaagcguacauccaccaagagcuuuaacaugguacaggcauucggucugcgcggccccggggaccuccagggaaauuuuggcgauuuacaacugaacaaacuugguacggaggacccgagauggccucagauagccgaauugguucccacugcuucggccuucauggggaugucucaguuuaaacugacacaccaaaauaacgaugaccauggcaauccaguguacuuccuaagguauuccggagcaaucaagcucgacccuaaaaaccccaauuacaacaaguggcuggagcuucuggagcagaauauugaugccuacaaaaccuuuccaaagaaggagaaaaagcagaaagcucccaaggaagaaucaacugaccagaugagugagccuccaaaagagcaacggguccagggcagcaucacacagcacacccgaacgcgcccguccgugcagcccgggccuaugauugaugugaacaccgacuga

SEQ ID NO: 749 - RNA, 1242 nt, Artificial Sequence
  derived and/or modified CDS sequence (opt3) from MERS-CoV__ALW82676__N
auggccagccccgcugcaccuagagccguguccuucgcggacaacaaugauaccacaaacacuaaucugucuaggggccgggggcgcaacccaaagccgcgagcugcccccaauaacacggucucaugguacaccggacucacacagcacgguaaaguuccucuuacuuuuccacccggccaaggggugccucugaaugcaaacaguaccccagcccagaaugcuggauauuggcguagacaggacaggaagaucaacacaggcaaugguauuaaacaguuggcaccccggugguacuucuauuacaccgggacuggaccugaggccgcuuuaccauuucgcgccguaaaggauggcauaguguggguccaugaagacggcgcgacagaugcaccgagcaccuucgggacgagaaaccccaauaacgacuccgccaucgugacucaauuugcuccuggaaccaaacugccaaagaauuuccacauugaggguacaggcgggaacucucagucgucaagcagggccaguuccguuucucggaacagcucccgcucaaguagccagggaucucgauccggcaauucaacuagagguaccagccccgggccuaguggaaucggcgcagugggcggggaucuacucuaucuggaccuucugaacagguugcaggcucucgaaucuggaaaggucaaacaaucccagccaaaggugauuaccaaaaaggaugccgcggccgcuaaaaauaagaugcggcauaagcguacaagcacgaaaucguuuaacaugguacaggcauucggucugcgcggccccggggaccugcagggaaauuuuggcgaucuccaauuaaacaagcuggguacugaggacccgagauggccucagaucgccgaacuugcucccacagccucugcauucauggggaugucccaguuuaaauugacccaccaaaauaacgaugaccauggcaauccaguuuacuuccugagguauucaggagccauaaagcuagacccuaaaaaccccaauuacaacaaguggcucgagcugcuugagcagaauaucgaugcuuacaaaacuuuuccaaagaaggagaaaaagcagaaagcgcccaaggaagaaaguacagaccagaugagcgagccuccaaaagagcaacgggugcagggcuccauuacccagcgaacgcgcaccagaccgucuguccagcccgggccuaugaucgaugugaacacagacuga

SEQ ID NO: 750 - RNA, 1242 nt, Artificial Sequence
  derived and/or modified CDS sequence (opt3) from MERS-CoV__AMQ49033__N
auggccagccccgcugcaccuagagccguguucuuugcggacaacaaugauaucaccaacacaaaucuguccaggggccgggggcgcaacccaaagccgcgagcugcccccaauaacacugucucuugguacacgggacucacccagcacgguaaaguuccucuuacauucccacccggccaaggggugccucugaaugcaaacucaacuccagcccagaaugcuggauauuggcguagacaggacaggaagauuaacaccggcaaugguauaaaacaguuggcaccccggugguacuuuuauuacacagggaccggaccugaggccgcuuuaccauuccgcgccguaaaggauggcaucguguggguccaugaagacggcgcgacugaugcaccgaguacauuugggaccagaaaccccaauaacgacagcgccauugugacgcaauucgcuccuggaacuaaacugccaaagaauuuucacaucgaggguaccggcgggaacucccagucuucgucaagggccagcaguguuucccggaacucuagccgcuccucaagucagggaagccgaucuggcaauuccacaagagguacuucacccgggccuagcggaauuggcgcagugggcggggaucuacucuaucuggaccuucugaacagguugcaggcucucgaaaguggaaaggucaaacaaucucagccaaaggugaucaccaaaaaggaugccgcggccgcuaaaaauaagaugcggcauaagcguacauccaccaagagcuucaacaugguacaggcauuuggucugcgcggccccggggaccugcagggaaauuucggcgaucuccaauuuaacaaauuagguacggaggacccgagauggccucagauagccgaacuggcucccacugccucggcauucauggggaugucucaguuuaaacuuacacaccaaaauaacgaugaccauggcaauccaguuuacuucuugagguauuccggagccaucaagcuggacccuaaaaaccccaauuacaacaaguggcuagagcuccuggagcagaauauugaugcuuacaaaaccuucccaaagaaggagaaaaagcagaaagcgcccaaggaagaaucaacugaccagaugagugagccuccaaaagagcaacgggugcagggcagcaucacacagcgaacccgcacgagaccguccguccagcccgggccuaugauugaugugaacaccgacuga

SEQ ID NO: 751 - RNA, 1242 nt, Artificial Sequence
  derived and/or modified CDS sequence (opt3) from MERS-CoV__AHL18098__N
auggccagcuccgcugcacccagagccgugucuuucgcggacaacaaugauaucaccaacacaaaucugucaaggggccgggggcgcaacccuaagccacgagcugccccgaauaacacugucaguugguacacgggacucacccagcacgguaaaguuccccuuacauuuccuccaggccaaggggugccccugaaugcaaacagcacuccugcccagaaugcuggauauuggcguagacaggacaggaagauuaacaccggcaaugguauaaaacaguuggcaccacggugguacuucuauuacacagggaccggacccgaggccgcuuuaccuuuucgcgccguaaaggauggcaucguguggguccaugaagacggcgcgacugaugcaccauccacauucgggaccagaaacccgaauaacgacucugccauugugacgcaauuugcucccggaacuaaacugccuaagaauuuccacaucgaggguaccggcgggaacucgcagucaagcaguagggccuccucuguuagccggaacuccucacgcaguagcucucagggaucccgaucaggcaauagcacaagagguaccaguccagggcccucuggaauuggcgcagugggcggggaucuacucuaucuggaccuucugaacagguugcaggcucucgaauccggaaaggucaaacaaagccagccuaaggugaucacuaaaaaggaugccgcggccgcuaaaaauaagaugcggcauaagcguacaucgaccaaaucuuuuaacaugguacaggcauucggucugcgcggcccaggggaccugcagggaaauuuuggcgaucuccaauuaaacaagcuggguacggaggaccccagauggccgcagauagccgaacuugcuccuacugccuccgcauucauggggaugucacaguuuaaauugacacaccaaaauaacgaugaccauggcaaucccguuuacuuccugagguauaguggagccaucaagcuagacccuaaaaacccaaauuacaacaaguggcucgagcugcuugagcagaauauugaugcuuacaaaaccuuucccaagaaggaaaacaaacagaaggcgccaaaagaggaaagcacugaccagauguccgagcccccuaaggagcaacgggugcagggcucuaucacacagcgaacccgcacgagaccaagcguccagccggggcccaugauugaugugaauaccgacuga

SEQ ID NO: 752 - RNA, 1242 nt, Artificial Sequence
  derived and/or modified CDS sequence (opt3) from MERS-CoV__AHX00738__N
auggccgcucccgcagccccuagagcggugagcuucgcugacaacaaugauaucaccaacacaaauauguccaggggccgggggcgcaacccaaagccgcgagccgcacccaauaacacugucucuugguacacgggacugacccagcacgguaaaguuccucucacauuuccacccggccaaggggugccucuuaaugccaacucaacuccagcucagaaugcaggauauuggcguagacaggacaggaagauuaacaccggcaaugguauaaaacagcuggcuccccggugguacuucuauuacacagggaccggaccugaggccgccuugccauuucgcgcgguaaaggauggcaucguguggguccaugaagacggcgcaacugaugccccgaguacauucgggaccagaaaccccaauaacgacagcgcuauugugacgcaauuugccccuggaacuaaauuaccaaagaauuuccacaucgaggguaccggcgggaacucccagucuucgucaagggcaagcaguguuucccggaacucuagccgcuccucaagucagggaagccgaucuggcaauuccacaagagguacuucacccgggccuagcggaauuggcgcugugggcggggaucugcuauaucucgaccugcuuaacaggcugcaggccuuggaaaguggaaaggucaaacaaucucagccaaaggugaucaccaaaaaggaugcggccgcagcuaaaaauaagaugcggcauaagcguacauccaccaagagcuuuaacaugguacaggccuucggucuccgcggccccggggaccugcagggaaauuuuggcgaucugcaacucaacaaauuagguacggaggacccgagauggccucagauagcugaacuggcccccacugcaucggccuucauggggaugucucaguuuaaacuuacacaccaaaauaacgaugaccauggcaauccaguuuacuucuugagguauuccggagcuaucaagcuggacccuaaaaaccccaauuacaacaaguggcuagagcuccuggagcagaauauugaugcguacaaaaccuuuccaaagaaggagaaaaagcagaaagcacccaaggaagaaucaacugaccagaugagugagccuccaaaagagcaacgggugcagggcagcaucacacagcgaacccgcacgagaccguccguccagcccgggccuaugauugaugugaacaccgacuga

SEQ ID NO: 753 - RNA, 1242 nt, Artificial Sequence
  derived and/or modified CDS sequence (opt3) from MERS-CoV__AHY22561__N
auggccagccccgcugcaccuagagccguguccuucgcggacaacaaugauaucaccaacacaaaucugucuaggggccgggggcgcaacccaaagccgcgagcugcccccaauaacacugucucaugguacacgggacucacccagcacgguaaaguuccucuuacauuuccacccggccaaggggugccucugaaugcaaacaguacuccagcccagaaugcuggauauuggcguagacaggacaggaagauuaacaccggcaaugguauaaaacaguuggcaccccggugguacuucuauuacacagggaccggaccugaggccgcuuuaccauuucgcgccguaaaggauggcaucguguggguccaugaagacggcgcgacugaugcaccgagcacauucgggaccagaaaccccaauaacgacuccgccauugugacgcaauuugcuccuggaacuaaacugccaaagaauuuccacaucgaggguaccggcgggaacucucagucgucaagcagggccaguuccguuucucggaacagcucccgcucaaguagccagggaucucgauccggcaauucaacaagagguacuagccccgggccuaguggaauuggcgcagugggcggggaucuacucuaucuggaccuucugaacagguugcaggcucucgaaucuggaaaggucaaacaaucccagccaaaggugaucaccaaaaaggaugccgcggccgcuaaaaauaagaugcggcauaagcguacaagcaccaaaucguuuaacaugguacaggcauucggucugcgcggccccggggaccugcagggaaauuuuggcgaucuccaauuaaacaagcuggguacggaggacccgagauggccucagauagccgaacuugcucccacugccucugcauucauggggaugucccaguuuaaauugacacaccaaaauaacgaugaccauggcaauccaguuuacuuccugagguauucaggagccaucaagcuagacccuaaaaaccccaauuacaacaaguggcucgagcugcuugagcagaauauugaugcuuacaaaaccuuuccaaagaaggaaaacaaacagaaggcgcccaaagaggaaaguacugaccagaugagcgagccuccaaaggagcaacgggugcagggcuccaucacacagcgaacccgcacgagaccgucuguccagcccgggccuaugauugaugugaauaccgacuga

SEQ ID NO: 754 - RNA, 1242 nt, Artificial Sequence
  derived and/or modified CDS sequence (opt3) from MERS-CoV__AHY22571__N
auggccgcucccgcagccccuagagcggugagcuucgcugacaacaaugauaucaccaacacaaaucuguccaggggccgggggcgcaacccaaagccgcgagccgcacccaauaacacugucucuugguacacgggacucacccagcacgguaaaguuccucuuacauuuccacccggccaaggggugccucugaaugccaacucaacuccagcucagaaugcaggauauuggcguagacaggacaggaagauuaacaccggcaaugguauaaaacaguuggcuccccggugguacuucuauuacacagggaccggaccugaggccgccuuaccauuucgcgcgguaaaggauggcaucguguggguccaugaagacggcgcaacugaugccccgaguacauucgggaccagaaaccccaauaacgacagcgcuauugugacgcaauuugccccuggaacuaaacugccaaagaauuuccacaucgaggguaccggcgggaacucccagucuucgucaagggcaagcaguguuucccggaacucuagccgcuccucaagucagggaagccgaucuagaaauuccacaaggggcacuucacccgguccuagcgggauuggagcugugggcggcgaucuacucuaucuggaccuucugaaccgguugcaggcccucgaaagugggaaggucaaacaaucucagccaaaggugaucaccaaaaaggaugcggccgcagcuaaaaauaagaugcgucauaagcgcacauccaccaagagcuuuaacaugguacaggccuucggacugagaggucccggcgaccugcaggggaauuuuggagaucuccaauuaaacaaacugggcacggaggacccgagguggccucagauagcugaacuugcccccacugcaucggccuucauggguaugucucaguuuaaauugacacaccaaaauaacgaugaccaugggaauccaguuuacuuccugcgguauuccggcgcuaucaagcuagacccuaaaaaccccaauuacaacaaguggcucgagcugcuugagcagaauauugaugcguacaaaaccuuuccaaagaaggaaaacaaacagaaggcacccaaagaggaaucaacugaccagaugagugagccuccaaaggagcaacgagugcagggaagcaucacacagcgcaccagaacgaggccguccguccagcccggcccuaugauugaugugaauaccgacuga

SEQ ID NO: 755 - RNA, 1242 nt, Artificial Sequence
  derived and/or modified CDS sequence (opt3) from MERS-CoV__ALA49381__N
auggccagccccgcugcaccuagagccguguccuucgcggacaacaaugauaucaccaacacaaaucugucuaggggccgggggcgcaacccaaagccgcgagcugcccccaauaacacugucucaugguacacgggacucacccagcacgguaaaguuccucuuacauuuccacccggccaaggggugccucugaaugcaaacaguacuccagcccagaaugcuggauauuggcguagacaggacaggaagauuaacaccggcaaugguauaaaacaguuggcaccccggugguacuucuauuacacagggaccggaccugaggccgcuuuaccauuucgcgccguaaaggauggcaucguguggguccaugaagacggcgcgacugaugcaccgagcacauucgggaccagaaaccccaauaacgacuccgccauugugacgcaauuugcuccuggaacuaaacugccaaagaauuuccacaucgaggguaccggcgggaacucucagucgucaagcagggccaguuccguuucucggaacagcucccgcucaaguagccagggaucucgauccggcaauucaacaagagguagcagucccgggccuucuggaauuggcgcagugggcggggaucuacucuaucuggaccuucugaacagguugcaggcucucgaauccggaaaggucaaacaaagccagccaaaggugaucacuaaaaaggaugccgcggccgcuaaaaauaagaugcggcauaagcguaccucgacaaaaucuuuuaacaugguacaggcauucggucugcgcggccccggggaccugcagggaaauuuuggcgaucuccaauuaaacaagcuggguaccgaggacccgagauggccucagauagccgaacuugcucccacggccuccgcauucauggggaugucacaguuuaaauugacucaccaaaauaacgaugaccauggcaauccaguuuacuuccugagguauaguggagccaucaagcuagacccuaaaaaccccaauuacaacaaguggcucgagcugcuugagcagaauauugaugcuuacaaaacauuuccaaagaaggagaaaaagcagaaagcgcccaaggaagaaagcaccgaccagauguccgagccuccaaaagagcaacgggugcagggcucuaucacucagcgaacacgcaccagaccgagcguccagcccgggccuaugauugaugugaacacggacuga

SEQ ID NO: 756 - RNA, 1242 nt, Artificial Sequence
  derived and/or modified CDS sequence (opt3) from MERS-CoV__ALA49392__N
auggccagccccgcugcaccuagagccguguccuucgcggacaacaaugauaucaccaacacaaaucugucuaggggccgggggcgcaacccaaagccgcgagcugcccccaauaacacugucucaugguacacgggacucacccagcacgguaaaguuccucuuacauuuccacccggccaaggggugccucugaaugcaaacaguacuccagcccagaaugcuggauauuggcguagacaggacaggaagauuaacaccggcaaugguauaaaacaguuggcaccccggugguacuucuauuacacagggaccggaccugaggccgcuuuaccauuucgcgccguaaaggauggcaucguguggguccaugaagacggcgcgacugaugcaccgagcacauucgggaccagaaaccccaauaacgacuccgccauugugacgcaauuugcuccuggaacuaaacugccaaagaauuuccacaucgaggguaccggcgggaacucucagucgucaagcagggccaguuccguuucucggaacagcucccgcucaaguagccagggaucucgauccggcaauucaacaagagguagcagucccgggccuucuggaauuggcgcagugggcggggaucuacucuaucuggaccuucugaacagguugcaggcucucgaauccggaaaggucaaacaaagccagccaaaggugaucacuaaaaaggaugccgcggccgcuaaaaauaagaugcggcauaagcguaccucgacaaaaucuuuuaacaugguacaggcauucggucugcgcggccccggggaccugcagggaaauuuuggcgaucuccaauuaaacaagcuggguaccgaggacccgagauggccucagauagccgaacuugcucccacggccuccgcauucauggggaugucacaguuuaaauugacucaccaaaauaacgaugaccauggcaauccaguuuacuuccugagguauaguggagccaucaagcuagacccuaaaaaccccaauuacaacaaguggcucgagcugcuugagcagaauauugaugcuuacaaaacauuuccaaagaaggagaaaaagcagaaagcgcccaaggaagaaagcaccgaccagauguccgagccuccaaaagagcaacgggugcgaggcucuaucacucagcgcacaagaaccaggccgagcguccagcccgggccuaugauugaugugaacacggacuga

SEQ ID NO: 757 - RNA, 1242 nt, Artificial Sequence
  derived and/or modified CDS sequence (opt3) from MERS-CoV__ALA49601__N
auggccagccccgcugcaccuagagccguguccuucgcggacaacaaugauaucaccaacacaaaucugucuaggggccgggggcgcaacccaaagccgcgagcugcccccaauaacacugucucaugguacacgggacucacccagcacgguaaaguuccucuuacauuuccacccggccaaggggugccucugaaugcaaacaguacuccagcccagaaugcuggauauuggcguagacaggacaggaagauuaacaccggcaaugguauaaaacaguuggcaccccggugguacuucuauuacacagggaccggaccugaggccgcuuuaccauuucgcgccguaaaggauggcaucguguggguccaugaagacggcgcgacugaugcaccgagcacauucgggaccagaaaccccaauaacgacuccgccauugugacgcaauuugcuccuggaacuaaacugccaaagaauuuccacaucgaggguaccggcgggaacucucagucgucaagcagggccaguuccguuucucggaacagcucccgcucaaguagccagggaucucgauccggcaauucaacaagagguacuagccccgggcuaaguggaauuggcgcagugggcggggaucuccuguaucuugaccuguugaacaggcuccaggcucuggaaucuggaaaggucaaacaaucccagccuaaggugaucaccaaaaaggaugccgcggccgcaaagaauaagaugcggcauaagcguacaagcaccaaaucguuuaacaugguacaggcuuucggucugcgcggcccaggggaccuccagggaaauuuuggcgauuuacaacugaacaaacuugguacggaggaccccagauggccgcagauagccgaauuggcuccuacugccucugcauucauggggaugucccaguuuaaacugacacaccaaaauaacgaugaccauggcaaucccguuuacuuccuaagguauucaggagccaucaagcucgacccuaaaaacccaaauuacaacaaguggcuggagcuucuggagcagaauauugaugcuuacaaaaccuuucccaagaaggagaaaaagcagaaagcgccaaaggaagaaaguacugaccagaugagcgagcccccuaaagagcaacgggugcagggcuccaucacacagcgaacccgcacgagaccaucuguccagccggggcccaugauugaugugaacaccgacuga

SEQ ID NO: 758 - RNA, 1242 nt, Artificial Sequence
  derived and/or modified CDS sequence (opt3) from MERS-CoV__ALA49843__N
auggccagccccgcugcaccuagagccguguccuucgcggacaacaaugauaucaccaacacaaaucugucuaggggccgggggcgcaacccaaagccgcgagcugcccccaauaacacugucucaugguacacgggacucacccagcacgguaaaguuccucuuacauuuccacccggccaaggggugccucugaaugcaaacaguacuccagcccagaaugcuggauauuggcguagacaggacaggaagauuaacaccggcaaugguauaaaacaguuggcaccccggugguacuucuauuacacagggaccggaccugaggccgcuuuaccauuucgcgccguaaaggauggcaucguguggguccaugaagacggcgcgacugaugcaccgagcacauucgggaccagaaaccccaauaacgacuccgccauugugacgcaauuugcuccuggaacuaaacugccaaagaauuuccacaucgaggguaccggcgggaacucucagucgucaagcagggccaguuccguuucucggaacagcucccgcucaaguagccagggaucucgauccggcaauucaacaagaugcacuagccccgguccuagugggauuggagcagugggcggcgaucuacucuaucuggaccuucugaacagguugcaggcucucgaaucugggaaggucaaacaaucccagccaaaggugaucaccaaaaaggaugccgcggccgcuaaaaauaagaugcggcauaagcguacaagcaccaaaucguuuaacaugguacaggcauucggacugcgcggucccggcgaccugcaggggaauuuuggagaucuccaauuaaacaagcugggcacggaggacccgagauggccucagauagccgaacuugcucccacugccucugcauucauggguaugucccaguuuaaauugacacaccaaaauaacgaugaccaugggaauccaguuuacuuccugagguauucaggcgccaucaagcuagacccuaaaaaccccaauuacaacaaguggcucgagcugcuugagcagaauauugaugcuuacaaaaccuuuccaaagaaggagaaaaagcagaaagcgcccaaggaagaaaguacugaccagaugagcgagccuccaaaagagcaacgggugcagggauccaucacacagcgaacccgcacgagaccgucuguccagcccggcccuaugauugaugugaacaccgacuga

SEQ ID NO: 759 - RNA, 1242 nt, Artificial Sequence
  derived and/or modified CDS sequence (opt3) from MERS-CoV__ALA49865__N
auggccagccccgcugcaccuagagccguguccuucgcggacaacaaugauaucaccaacacaaaucugucuaggggccgggggcgcaacccaaagccgcgagcugcccccaauaacacugucucaugguacacgggacucacccagcacgguaaaguuccucuuacauuuccacccggccaaggggugccucugaaugcaaacaguacuccagcccagaaugcuggauauuggcguagacaggacaggaagauuaacaccggcaaugguauaaaacaguuggcaccccggugguacuucuauuacaucgggacaggaccugaggccgcuuuaccauuucgcgccguaaaggauggcauuguguggguccaugaagacggcgcgaccgaugcaccgagcacuuucgggacaagaaaccccaauaacgacuccgccaucgugacccaauuugcuccuggaacgaaacugccaaagaauuuccacauugaggguacuggcgggaacucucagucgucaagcagggccaguuccguuucucggaacagcucccgcucaaguagccagggaucucgauccggcaauucaaccagagguacaagccccgggccuaguggaaucggcgcagugggcggggaucuacucuaucuggaccuucugaacagguugcaggcucucgaaucuggaaaggucaaacaaucccagccaaaggugauaacuaaaaaggaugccgcggccgcuaaaaauaagaugcggcauaagcguaccagcacaaaaucguuuaacaugguacaggcauucggucugcgcggccccggggaccugcagggaaauuuuggcgaucuccaauuaaacaagcuggguaccgaggacccgagauggccucagaucgccgaacuugcucccacggccucugcauucauggggaugucccaguuuaaauugacucaccaaaauaacgaugaccauggcaauccaguuuacuuccugagguauucaggagccauuaagcuagacccuaaaaaccccaauuacaacaaguggcucgagcugcuugagcagaauaucgaugcuuacaaaacauuuccaaagaaggagaaaaagcagaaagcgcccaaggaagaaaguaccgaccagaugagcgagccuccaaaagagcaacgggugcagggcuccauuacucagcgaacacgcaccagaccgucuguccagcccgggccuaugaucgaugugaacacggacuga

SEQ ID NO: 760 - RNA, 1242 nt, Artificial Sequence
  derived and/or modified CDS sequence (opt3) from MERS-CoV__ALA49909__N
auggccagccccgcugcaccuagagccguguccuucgcggacaacaaugauaucaccaacacaaaucugucuaggggccgggggcgcaacccaaagccgcgagcugcccccaauaacacugucucaugguacacgggacucacccagcacgguaaaguuccucuuacauuuccacccggccaaggggugccucugaaugcaaacaguacuccagcccagaaugcuggauauuggcguagacaggacaggaagauuaacaccggcaaugguauaaaacaguuggcaccccggugguacuucuauuacacagggaccggaccugaggccgcuuuaccauuucgcgccguaaaggauggcaucguguggguccaugaacacggcgcgacugacgcaccgagcacauucgggaccagaaaccccaauaacgauuccgccauugugacgcaauuugcuccuggaacuaaacugccaaagaauuuccauaucgaggguaccggcgggaacucucagucgucaagcagggccaguuccguuucucggaacagcucccgcucaaguagccagggaucucgauccggcaauucaacaagaugcacuagccccgguccuagugggauuggagcagugggcggcgaccuacucuaucuggaucuucugaacagguugcaggcucucgaaucugggaaggucaaacaaucccagccaaaggugaucaccaaaaaggacgccgcggccgcuaaaaauaagaugcggcacaagcguacaagcaccaaaucguuuaacaugguacaggcauucggacugcgcggucccggcgaucugcaggggaauuuuggagaccuccaauuaaacaagcugggcacggaggauccgagauggccucagauagccgaacuugcucccacugccucugcauucauggguaugucccaguuuaaauugacacaucaaaauaacgacgaucacgggaauccaguuuacuuccugagguauucaggcgccaucaagcuagacccuaaaaaccccaauuacaacaaguggcucgagcugcuugagcagaauauugacgcuuacaaaaccuuuccaaagaaggagaaaaagcagaaagcgcccaaggaagaaaguacugaucagaugagcgagccuccaaaagagcaacgggugcagggauccaucacacagcgaacccgcacgagaccgucuguccagcccggcccuaugauugacgugaacaccgauuga

SEQ ID NO: 761 - RNA, 4062 nt, Artificial Sequence
  derived and/or modified CDS sequence (opt4) from MERS-CoV__AFS88936__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuuccagaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 762 - RNA, 4062 nt, Artificial Sequence
  derived and/or modified CDS sequence (opt4) from MERS-CoV__AFY13307__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagauuccugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuuccacaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 763 - RNA, 4062 nt, Artificial Sequence
  derived and/or modified CDS sequence (opt4) from MERS-CoV__AGH58717__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccgugaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaacuacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcauccugagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuuccagaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacagcgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 764 - RNA, 4062 nt, Artificial Sequence
  derived and/or modified CDS sequence (opt4) from MERS-CoV__AGN52936__S
augauccacagcguguuccugcugauguuccugcugacccccaccgagagcuacguggacgugggccccgacagcaucaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuuccacaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 765 - RNA, 4062 nt, Artificial Sequence
  derived and/or modified CDS sequence (opt4) from MERS-CoV__AGN70951__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccacgugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 766 - RNA, 4062 nt, Artificial Sequence
  derived and/or modified CDS sequence (opt4) from MERS-CoV__AGV08408__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcggcgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 767 - RNA, 4062 nt, Artificial Sequence
  derived and/or modified CDS sequence (opt4) from MERS-CoV__AGV08455__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcuacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 768 - RNA, 4062 nt, Artificial Sequence
  derived and/or modified CDS sequence (opt4) from MERS-CoV__AGV08467__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaucggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 769 - RNA, 4062 nt, Artificial Sequence
  derived and/or modified CDS sequence (opt4) from MERS-CoV__AGV08492__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucgugagccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccacgugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 770 - RNA, 4062 nt, Artificial Sequence
  derived and/or modified CDS sequence (opt4) from MERS-CoV__AGV08584__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgccugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 771 - RNA, 4062 nt, Artificial Sequence
  derived and/or modified CDS sequence (opt4) from MERS-CoV__AHB33326__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccuacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcaccagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacagccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 772 - RNA, 4062 nt, Artificial Sequence
  derived and/or modified CDS sequence (opt4) from MERS-CoV__AHC74088__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcuucgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 773 - RNA, 4062 nt, Artificial Sequence
  derived and/or modified CDS sequence (opt4) from MERS-CoV__AHI48528__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagcccccccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggugaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 774 - RNA, 4062 nt, Artificial Sequence
  derived and/or modified CDS sequence (opt4) from MERS-CoV__AHI48550__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuuccacaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccugcagccccacaaggugcacgugcacuga

SEQ ID NO: 775 - RNA, 4062 nt, Artificial Sequence
  derived and/or modified CDS sequence (opt4) from MERS-CoV__AHI48583__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacguguucaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuuccacaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 776 - RNA, 4062 nt, Artificial Sequence
  derived and/or modified CDS sequence (opt4) from MERS-CoV__AHI48605__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuuccacaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 777 - RNA, 4062 nt, Artificial Sequence
  derived and/or modified CDS sequence (opt4) from MERS-CoV__AHY21469__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccgugaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaacuacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcauccugagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaccagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuuccagaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacagcgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 778 - RNA, 4062 nt, Artificial Sequence
  derived and/or modified CDS sequence (opt4) from MERS-CoV__AHZ64057__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucuucagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaacagagcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 779 - RNA, 4062 nt, Artificial Sequence
  derived and/or modified CDS sequence (opt4) from MERS-CoV__AID50418__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 780 - RNA, 4062 nt, Artificial Sequence
  derived and/or modified CDS sequence (opt4) from MERS-CoV__AID55068__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaacagagcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 781 - RNA, 4062 nt, Artificial Sequence
  derived and/or modified CDS sequence (opt4) from MERS-CoV__AID55073__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaacuucaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 782 - RNA, 4062 nt, Artificial Sequence
  derived and/or modified CDS sequence (opt4) from MERS-CoV__AIY60528__S
augauccacagcguguuccugcugauguuccugcugacccccaccgagagcuacguggacgugggccccgacagcuucaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccagaacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacagccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 783 - RNA, 4062 nt, Artificial Sequence
  derived and/or modified CDS sequence (opt4) from MERS-CoV__AIY60558__S
augauccacagcguguuccugcugauguuccugcugacccccaccgagagcuacguggacgugggccccgacagcuucaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacagccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 784 - RNA, 4062 nt, Artificial Sequence
  derived and/or modified CDS sequence (opt4) from MERS-CoV__AIZ74450__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcaccagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacagccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 785 - RNA, 4062 nt, Artificial Sequence
  derived and/or modified CDS sequence (opt4) from MERS-CoV__AJD81440__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucaaccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 786 - RNA, 4062 nt, Artificial Sequence
  derived and/or modified CDS sequence (opt4) from MERS-CoV__AKI29284__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcgccuucuucauccugugcugcaccggcugcggcaccaacugcaugggcaagcugaagugcaacagaugcugcgacagauacgaggaguacgaccuggagccccacaaggugcacgugcacuga

SEQ ID NO: 787 - RNA, 4062 nt, Artificial Sequence
  derived and/or modified CDS sequence (opt4) from MERS-CoV__AKL59401__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagagccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcauccugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 788 - RNA, 4062 nt, Artificial Sequence
  derived and/or modified CDS sequence (opt4) from MERS-CoV__AKM76229__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcccccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacaucugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacagccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 789 - RNA, 4062 nt, Artificial Sequence
  derived and/or modified CDS sequence (opt4) from MERS-CoV__AKM76239__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgagcugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacaucugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacguggccaaccccaccaacugcaucgcccccgugaacggcuacuucaucaagaccaacaacaccagaaucguggacgaguggagcuacaccggcagcagcuucuacagccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacuucagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 790 - RNA, 4062 nt, Artificial Sequence
  derived and/or modified CDS sequence (opt4) from MERS-CoV__AKN11072__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaccgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 791 - RNA, 4062 nt, Artificial Sequence
  derived and/or modified CDS sequence (opt4) from MERS-CoV__AKN11074__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaccgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagcacuucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 792 - RNA, 4062 nt, Artificial Sequence
  derived and/or modified CDS sequence (opt4) from MERS-CoV__AKN24803__S
auggugcacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaacuucaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugagccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 793 - RNA, 4062 nt, Artificial Sequence
  derived and/or modified CDS sequence (opt4) from MERS-CoV__AKN24812__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucugcguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaacuucaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccugcagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagagcaacagaugcugcgacagauacgaggaguacgaccuggagccccacaaggugcacgugcacuga

SEQ ID NO: 794 - RNA, 4062 nt, Artificial Sequence
  derived and/or modified CDS sequence (opt4) from MERS-CoV__AKN24830__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaacuucaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggccccaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 795 - RNA, 4062 nt, Artificial Sequence
  derived and/or modified CDS sequence (opt4) from MERS-CoV__ALB08257__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucaucagaagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 796 - RNA, 4062 nt, Artificial Sequence
  derived and/or modified CDS sequence (opt4) from MERS-CoV__ALB08311__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggcuacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacggcagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 797 - RNA, 4062 nt, Artificial Sequence
  derived and/or modified CDS sequence (opt4) from MERS-CoV__ALB08322__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggcuacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacggcagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagcugcacaaggugcacgugcacuga

SEQ ID NO: 798 - RNA, 4062 nt, Artificial Sequence
  derived and/or modified CDS sequence (opt4) from MERS-CoV__ALD51904__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcgccaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 799 - RNA, 4062 nt, Artificial Sequence
  derived and/or modified CDS sequence (opt4) from MERS-CoV__ALJ54446__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacuucuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaucugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 800 - RNA, 4062 nt, Artificial Sequence
  derived and/or modified CDS sequence (opt4) from MERS-CoV__ALJ54448__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccauccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 801 - RNA, 4062 nt, Artificial Sequence
  derived and/or modified CDS sequence (opt4) from MERS-CoV__ALJ54450__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagauacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugagcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 802 - RNA, 4062 nt, Artificial Sequence
  derived and/or modified CDS sequence (opt4) from MERS-CoV__ALJ54453__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaacuacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 803 - RNA, 4062 nt, Artificial Sequence
  derived and/or modified CDS sequence (opt4) from MERS-CoV__ALJ54455__S
augauccacagcguguuccugcugauguuccugcugacccccaccgagagcuacguggacgugggccccgacagcgugaagagcgccugcaucgccguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaagcugaagagaagagacagcaccuacggcccccugcagacccccgugggcugcgugcugggccuggugaacagcagccuguucguggaggacugcaagcugccccugggccagagccugugcgcccugcccgacacccccagcacccugaagcccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 804 - RNA, 4062 nt, Artificial Sequence
  derived and/or modified CDS sequence (opt4) from MERS-CoV__ALJ54456__S
augauccacagcguguuccugcugauguuccugcugacccccaccgagagcuacguggacgugggccccgacagcgugaagagcgccugcaucgccguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugaagcccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 805 - RNA, 4062 nt, Artificial Sequence
  derived and/or modified CDS sequence (opt4) from MERS-CoV__ALJ54461__S
augauccacagcguguuccugcugauguuccugcugacccccaccgagagcuacguggacgugggccccgacagcgugaagcccgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugaccagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagaccagcgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 806 - RNA, 4062 nt, Artificial Sequence
  derived and/or modified CDS sequence (opt4) from MERS-CoV__ALJ54468__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaucugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 807 - RNA, 4062 nt, Artificial Sequence
  derived and/or modified CDS sequence (opt4) from MERS-CoV__ALJ54471__S
augauccacagcguguaccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccacaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 808 - RNA, 4062 nt, Artificial Sequence
  derived and/or modified CDS sequence (opt4) from MERS-CoV__ALJ54472__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugcugcagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccuggcccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucgugagccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 809 - RNA, 4062 nt, Artificial Sequence
  derived and/or modified CDS sequence (opt4) from MERS-CoV__ALJ54474__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccagcaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagagugguggacgaguggagcuacaccggcagcagcuucuacgcccccgagcccaucaccagccugaacaccaaguacguggccccccaggugaccuaccagaacaucagcaccaaccugccccccccccugcugagcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 810 - RNA, 4062 nt, Artificial Sequence
  derived and/or modified CDS sequence (opt4) from MERS-CoV__ALJ54483__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucuuccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 811 - RNA, 4062 nt, Artificial Sequence
  derived and/or modified CDS sequence (opt4) from MERS-CoV__ALJ54486__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagauacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggugagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugagcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 812 - RNA, 4062 nt, Artificial Sequence
  derived and/or modified CDS sequence (opt4) from MERS-CoV__ALJ54488__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacaucuacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 813 - RNA, 4062 nt, Artificial Sequence
  derived and/or modified CDS sequence (opt4) from MERS-CoV__ALJ54490__S
augauccacagcguguuccugcugauguuccugcugacccccaccgagagcuacguggacgugggccccgacagcgugaagagcgccugcaucgccguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacggcagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugaagcccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 814 - RNA, 4062 nt, Artificial Sequence
  derived and/or modified CDS sequence (opt4) from MERS-CoV__ALJ54495__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggugagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcauccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 815 - RNA, 4062 nt, Artificial Sequence
  derived and/or modified CDS sequence (opt4) from MERS-CoV__ALJ54496__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcccagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgacuggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 816 - RNA, 4062 nt, Artificial Sequence
  derived and/or modified CDS sequence (opt4) from MERS-CoV__ALJ54500__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagccugcugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 817 - RNA, 4062 nt, Artificial Sequence
  derived and/or modified CDS sequence (opt4) from MERS-CoV__ALJ54501__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcacccugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 818 - RNA, 4062 nt, Artificial Sequence
  derived and/or modified CDS sequence (opt4) from MERS-CoV__ALJ54502__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgugagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaaguucaacagaugcugcgacagauacgaggaguacgaccuggagccccacaaggugcacgugcacuga

SEQ ID NO: 819 - RNA, 4062 nt, Artificial Sequence
  derived and/or modified CDS sequence (opt4) from MERS-CoV__ALJ54512__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgcccaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 820 - RNA, 4062 nt, Artificial Sequence
  derived and/or modified CDS sequence (opt4) from MERS-CoV__ALJ54517__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcaacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccagaaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 821 - RNA, 4062 nt, Artificial Sequence
  derived and/or modified CDS sequence (opt4) from MERS-CoV__ALJ54518__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcccagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 822 - RNA, 4062 nt, Artificial Sequence
  derived and/or modified CDS sequence (opt4) from MERS-CoV__ALW82691__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugagaagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 823 - RNA, 4062 nt, Artificial Sequence
  derived and/or modified CDS sequence (opt4) from MERS-CoV__ALW82742__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccauccagaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 824 - RNA, 4062 nt, Artificial Sequence
  derived and/or modified CDS sequence (opt4) from MERS-CoV__ALW82753__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccagcaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccaggugggccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugagcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 825 - RNA, 4062 nt, Artificial Sequence
  derived and/or modified CDS sequence (opt4) from MERS-CoV__ALX27228__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccguguggaaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugagcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 826 - RNA, 4062 nt, Artificial Sequence
  derived and/or modified CDS sequence (opt4) from MERS-CoV__ALX27232__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcuacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgacguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 827 - RNA, 4062 nt, Artificial Sequence
  derived and/or modified CDS sequence (opt4) from MERS-CoV__AMQ48993__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaucguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucacccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugagcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 828 - RNA, 4062 nt, Artificial Sequence
  derived and/or modified CDS sequence (opt4) from MERS-CoV__AMW90844__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccuuccaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 829 - RNA, 4062 nt, Artificial Sequence
  derived and/or modified CDS sequence (opt4) from MERS-CoV__AMW90852__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaacuucaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgacuucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 830 - RNA, 4062 nt, Artificial Sequence
  derived and/or modified CDS sequence (opt4) from MERS-CoV__AMW90853__S
augauccacagcguguuccugcugauguuccugcugacccccaccgagagcuacguggacgugggcagcgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggcuacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaacuucaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 831 - RNA, 4062 nt, Artificial Sequence
  derived and/or modified CDS sequence (opt4) from MERS-CoV__ANC28656__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacggcagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 832 - RNA, 4062 nt, Artificial Sequence
  derived and/or modified CDS sequence (opt4) from MERS-CoV__ANC28678__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucugcagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacggcagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 833 - RNA, 4059 nt, Artificial Sequence
  derived and/or modified CDS sequence (opt4) from MERS-CoV__AHL18090__S
augauccacagcguguuccugcugauguuccugcugacccccaccgagagcuacguggacgugggccuggacagcgccaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaacuacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucagcagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaagaagaccaagacccacgccacccuguucggcagcguggccugcgagcacaucagcagcaccaugagccaguacagcagaagcaccagaagcacccugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggccagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcagcagaaucgccaucgaggaccugcuguucgacaaggugaccaucgccgaccccggcuacaugcagggcuacgacgacugcaugcagcagggccccagcagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuuccagaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacagcgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaaguggcccugguacaucuggcugggcuucaucgccggccugguggcccuggcccugugcguguucuucauccugugcugcaccggcugcggcaccaacugcaugggcaagcugaagagaaacagaugcugcgacagauacgaggaguacgaccuggagccccacaaggugcacgugcacuga

SEQ ID NO: 834 - RNA, 4062 nt, Artificial Sequence
  derived and/or modified CDS sequence (opt4) from MERS-CoV__AHX00731__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugggcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccaguucaacagcagcuacuucaagcugagcauccccaccaacuucagcuucggcgugacccaggaguacauccagaccaccauccagaaggugaccguggacugcaagcaguacaucugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacagccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 835 - RNA, 4062 nt, Artificial Sequence
  derived and/or modified CDS sequence (opt4) from MERS-CoV__AHX71946__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagccacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 836 - RNA, 4062 nt, Artificial Sequence
  derived and/or modified CDS sequence (opt4) from MERS-CoV__AHY22545__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaacagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 837 - RNA, 4062 nt, Artificial Sequence
  derived and/or modified CDS sequence (opt4) from MERS-CoV__AHY22555__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaacuacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccagcuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacagcaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuuccacaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 838 - RNA, 4062 nt, Artificial Sequence
  derived and/or modified CDS sequence (opt4) from MERS-CoV__AHY22565__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaucaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccagcuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccagcaaccccaccaacugcaucgcccccgugaacggcuacuucaucaagaccaacaacaccagaaucguggacgaguggagcuacaccggcagcagcuucuacagccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 839 - RNA, 4062 nt, Artificial Sequence
  derived and/or modified CDS sequence (opt4) from MERS-CoV__AJG44069__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccacccccagaaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcccccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacaucugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacagccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 840 - RNA, 4062 nt, Artificial Sequence
  derived and/or modified CDS sequence (opt4) from MERS-CoV__AJG44080__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcaucaagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcccccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacaucugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacagccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 841 - RNA, 4062 nt, Artificial Sequence
  derived and/or modified CDS sequence (opt4) from MERS-CoV__AJG44102__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugagccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaucagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacagccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 842 - RNA, 4062 nt, Artificial Sequence
  derived and/or modified CDS sequence (opt4) from MERS-CoV__AJG44124__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccauguuccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacagccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 843 - RNA, 4062 nt, Artificial Sequence
  derived and/or modified CDS sequence (opt4) from MERS-CoV__ALL26396__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccugagcguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugagcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 844 - RNA, 4062 nt, Artificial Sequence
  derived and/or modified CDS sequence (opt4) from MERS-CoV__ALS20350__S
augauccacagcguguuccugcugauguuccugcugacccccaccgagagcuacguggacgugggccccgacagcgccaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaacuacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugaccgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcuaccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcaccagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuuccagaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgaccuggccaaccccaccaacugcaucgcccccgugaacggcuacuucaucaagaccaacaacaccagaaucguggacgaguggagcuacaccggcagcagcuucuacgcccccgagcccaucaccagcuucaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 845 - RNA, 4062 nt, Artificial Sequence
  derived and/or modified CDS sequence (opt4) from MERS-CoV__ALT66880__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacagccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 846 - RNA, 4062 nt, Artificial Sequence
  derived and/or modified CDS sequence (opt4) from MERS-CoV__ALA49341__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccacccugcagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaucugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 847 - RNA, 4062 nt, Artificial Sequence
  derived and/or modified CDS sequence (opt4) from MERS-CoV__ALA49352__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuacuacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 848 - RNA, 4062 nt, Artificial Sequence
  derived and/or modified CDS sequence (opt4) from MERS-CoV__ALA49363__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccaccuuccccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 849 - RNA, 4062 nt, Artificial Sequence
  derived and/or modified CDS sequence (opt4) from MERS-CoV__ALA49374__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaacuucaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugagcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 850 - RNA, 4062 nt, Artificial Sequence
  derived and/or modified CDS sequence (opt4) from MERS-CoV__ALA49396__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcagcagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugagcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 851 - RNA, 4062 nt, Artificial Sequence
  derived and/or modified CDS sequence (opt4) from MERS-CoV__ALA49451__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaaccugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 852 - RNA, 4062 nt, Artificial Sequence
  derived and/or modified CDS sequence (opt4) from MERS-CoV__ALA49473__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccaccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaaguucaacagaugcugcgacagauacgaggaguacgaccuggagccccacaaggugcacgugcacuga

SEQ ID NO: 853 - RNA, 4062 nt, Artificial Sequence
  derived and/or modified CDS sequence (opt4) from MERS-CoV__ALA49583__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaaguucaacagaugcugcgacagauacgaggaguacgaccuggagccccacaaggugcacgugcacuga

SEQ ID NO: 854 - RNA, 4062 nt, Artificial Sequence
  derived and/or modified CDS sequence (opt4) from MERS-CoV__ALA49649__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccacccccaagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccauccccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccacaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugagcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 855 - RNA, 4062 nt, Artificial Sequence
  derived and/or modified CDS sequence (opt4) from MERS-CoV__ALA49660__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaaguucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgacaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugagcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 856 - RNA, 4062 nt, Artificial Sequence
  derived and/or modified CDS sequence (opt4) from MERS-CoV__ALA49671__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccaacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgacaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugagcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 857 - RNA, 4062 nt, Artificial Sequence
  derived and/or modified CDS sequence (opt4) from MERS-CoV__ALA49682__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugagcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 858 - RNA, 4062 nt, Artificial Sequence
  derived and/or modified CDS sequence (opt4) from MERS-CoV__ALA49803__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacagauacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccagcaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagagugguggacgaguggagcuacaccggcagcagcuucuacgcccccgagcccaucaccagccugaacaccaaguacguggccccccaggugaccuaccagaacaucagcaccaaccugccccccccccugcugagcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 859 - RNA, 4062 nt, Artificial Sequence
  derived and/or modified CDS sequence (opt4) from MERS-CoV__ALA49836__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcagcagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 860 - RNA, 4062 nt, Artificial Sequence
  derived and/or modified CDS sequence (opt4) from MERS-CoV__ALA49957__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccaccaucguggacgaguggagcuacaccggcagcagcuucuacgcccccgagcccaucaccagccugaacaccaaguacguggccccccaggugaccuaccagaacaucagcaccaaccugccccccccccugcugggcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 861 - RNA, 4062 nt, Artificial Sequence
  derived and/or modified CDS sequence (opt4) from MERS-CoV__ALA50067__S
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcagcggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccagaagcgugagaagcgugcccggcgagaugagacuggccagcaucgccuucaaccaccccauccagguggaccagcugaacagcagcuacuucaagcugagcauccccaccaacuucagcuucggcgugacccaggaguacauccagaccaccauccagaaggugaccguggacugcaagcaguacgugugcaacggcuuccagaagugcgagcagcugcugagagaguacggccaguucugcagcaagaucaaccaggcccugcacggcgccaaccugagacaggacgacagcgugagaaaccuguucgccagcgugaagagcagccagagcagccccaucauccccggcuucggcggcgacuucaaccugacccugcuggagcccgugagcaucagcaccggcagcagaagcgccagaagcgccaucgaggaccugcuguucgacaaggugaccaucgccgaccccggcuacaugcagggcuacgacgacugcaugcagcagggccccgccagcgccagagaccugaucugcgcccaguacguggccggcuacaaggugcugcccccccugauggacgugaacauggaggccgccuacaccagcagccugcugggcagcaucgccggcgugggcuggaccgccggccugagcagcuucgccgccauccccuucgcccagagcaucuucuacagacugaacggcgugggcaucacccagcaggugcugagcgagaaccagaagcugaucgccaacaaguucaaccaggcccugggcgccaugcagaccggcuucaccaccaccaacgaggccuucagaaaggugcaggacgccgugaacaacaacgcccaggcccugagcaagcuggccagcgagcugagcaacaccuucggcgccaucagcgccagcaucggcgacaucauccagagacuggacgugcuggagcaggacgcccagaucgacagacugaucaacggcagacugaccacccugaacgccuucguggcccagcagcuggugagaagcgagagcgccgcccugagcgcccagcuggccaaggacaaggugaacgagugcgugaaggcccagagcaagagaagcggcuucugcggccagggcacccacaucgugagcuucguggugaacgcccccaacggccuguacuucaugcacgugggcuacuaccccagcaaccacaucgagguggugagcgccuacggccugugcgacgccgccaaccccaccaacugcaucgcccccgugaacggcuacuucaucaagaccaacaacaccagaaucguggacgaguggagcuacaccggcagcagcuucuacgcccccgagcccaucaccagccugaacaccaaguacguggccccccaggugaccuaccagaacaucagcaccaaccugccccccccccugcugagcaacagcaccggcaucgacuuccaggacgagcuggacgaguucuucaagaacgugagcaccagcauccccaacuucggcagccugacccagaucaacaccacccugcuggaccugaccuacgagaugcugagccugcagcagguggugaaggcccugaacgagagcuacaucgaccugaaggagcugggcaacuacaccuacuacaacaaguggcccugguacaucuggcugggcuucaucgccggccugguggcccuggcccugugcguguucuucauccugugcugcaccggcugcggcaccaacugcaugggcaagcugaagugcaacagaugcugcgacagauacgaggaguacgaccuggagccccacaaggugcacgugcacuga

SEQ ID NO: 862 - RNA, 249 nt, Artificial Sequence
  derived and/or modified CDS sequence (opt4) from MERS-CoV__AGH58723__E
augcugcccuucgugcaggagagaaucggccuguucaucgugaacuucuucaucuucaccguggugugcgccaucacccugcuggugugcauggccuuccugaccgccaccagacugugcgugcagugcaugaccggcuucaacacccugcuggugcagcccgcccuguaccuguacaacaccggcagaagcguguacgugaaguuccaggacagcaagcccccccugccccccgacgaguggguguga

SEQ ID NO: 863 - RNA, 249 nt, Artificial Sequence
  derived and/or modified CDS sequence (opt4) from MERS-CoV__AGV08472__E
augcugcccuucgugcaggagagagugggccuguucaucgugaacuucuucaucuucaccguggugugcgccaucacccugcuggugugcauggccuuccugaccgccaccagacugugcgugcagugcaugaccggcuucaacacccugcuggugcagcccgcccuguaccuguacaacaccggcagaagcguguacgugaaguuccaggacagcaagcccccccugccccccgacgaguggguguga

SEQ ID NO: 864 - RNA, 249 nt, Artificial Sequence
  derived and/or modified CDS sequence (opt4) from MERS-CoV__AGV08540__E
augcugcccuucgugcaggagagaaucggccuguucaucgugaaguucuucaucuucaccguggugugcgccaucacccugcuggugugcauggccuuccugaccgccaccagacugugcgugcagugcaugaccggcuucaacacccugcuggugcagcccgcccuguaccuguacaacaccggcagaagcguguacgugaaguuccaggacagcaagcccccccugccccccgacgaguggguguga

SEQ ID NO: 865 - RNA, 249 nt, Artificial Sequence
  derived and/or modified CDS sequence (opt4) from MERS-CoV__ALX27237__E
augcugcccuucgugcaggagagaaucggccuguucaucgugaacuucuucaucuucaccguggugugcgccaucacccugcuggugugcauggccuuccugaccgccaccagacugugcgugcagugcaugaccggcuucaacacccugcuggugcagcccgcccuguaccuguacaacaccggcagaagcguguacgugaaguuccaggacagcaagcccccccugcccagcgacgaguggguguga

SEQ ID NO: 866 - RNA, 249 nt, Artificial Sequence
  derived and/or modified CDS sequence (opt4) from MERS-CoV__ALR69646__E
augcugcccuucgugcaggagagaaucggccuguucaucgugaacuucuucaucuucaccguggugugcgccaucacccugcuggugugcauggccuuccugaccgccaccagacugugcgugcagugcaucaccggcuucaacacccugcuggugcagcccgcccuguaccuguacaacaccggcagaagcguguacgugaaguuccaggacagcaagcccccccugccccccgacgaguggguguga

SEQ ID NO: 867 - RNA, 249 nt, Artificial Sequence
  derived and/or modified CDS sequence (opt4) from MERS-CoV__ALA49346__E
augcugcccuucgugcaggagagaaucggccuguucaucgugaacuucagcaucuucaccguggugugcgccaucacccugcuggugugcauggccuuccugaccgccaccagacugugcgugcagugcaugaccggcuucaacacccugcuggugcagcccgcccuguaccuguacaacaccggcagaagcguguacgugaaguuccaggacagcaagcccccccugccccccgacgaguggguguga

SEQ ID NO: 868 - RNA, 249 nt, Artificial Sequence
  derived and/or modified CDS sequence (opt4) from MERS-CoV__ALA49390__E
augcugcccuucgugcaggagagaaucggccuguucaucgugaacuucuucaucuucaccguggugugcgccaucacccugcuggugugcauggccuuccugaccgccaccagacugugcgugcagugcaugaccggccugaacacccugcuggugcagcccgcccuguaccuguacaacaccggcagaagcguguacgugaaguuccaggacagcaagcccccccugccccccgacgaguggguguga

SEQ ID NO: 869 - RNA, 660 nt, Artificial Sequence
  derived and/or modified CDS sequence (opt4) from MERS-CoV__AFS88942__M
augagcaacaugacccagcugaccgaggcccagaucaucgccaucaucaaggacuggaacuucgccuggagccugaucuuccugcugaucaccaucgugcugcaguacggcuaccccagcagaagcaugaccguguacguguucaagauguucgugcuguggcugcuguggcccagcagcauggcccugagcaucuucagcgccguguaccccaucgaccuggccagccagaucaucagcggcaucguggccgccgugagcgccaugauguggaucagcuacuucgugcagagcaucagacuguucaugagaaccggcagcugguggagcuucaaccccgagaccaacugccugcugaacgugcccuucggcggcaccaccguggugagaccccugguggaggacagcaccagcgugaccgccguggugaccaacggccaccugaagauggccggcaugcacuucggcgccugcgacuacgacagacugcccaacgaggugaccguggccaagcccaacgugcugaucgcccugaagauggugaagagacagagcuacggcaccaacagcggcguggccaucuaccacagauacaaggccggcaacuacagaagcccccccaucaccgccgacaucgagcuggcccugcugagagccuga

SEQ ID NO: 870 - RNA, 660 nt, Artificial Sequence
  derived and/or modified CDS sequence (opt4) from MERS-CoV__AGH58718__M
augagcaacaugacccagcugaccgaggcccagaucaucgccgugaucaaggacuggaacuucgccuggagccugaucuuccugcugaucaccaucgugcugcaguacggcuaccccagcagaagcaugaccguguacguguucaagauguucgugcuguggcugcuguggcccagcagcauggcccugagcaucuucagcaccguguaccccaucgaccuggccagccagaucaucagcggcaucguggccgccgugagcgccaugauguggaucagcuacuucgugcagagcaucagacuguucaugagaaccggcagcugguggagcuucaaccccgagaccaacugccugcugaacgugcccuucggcggcaccaccguggugagaccccugguggaggacagcaccagcgugaccgccguggugaccaacggccaccugaagauggccggcaugcacuucggcgccugcgacuacgacagacugcccaacgaggugaccguggccaagcccaacgugcugaucgcccugaagauggugaagagacagagcuacggcaccaacagcggcguggccaucuaccacagauacaaggccggcaacuacagaagcccccccaucaccgccgacaucgagcuggcccugcugagagccuga

SEQ ID NO: 871 - RNA, 660 nt, Artificial Sequence
  derived and/or modified CDS sequence (opt4) from MERS-CoV__AGV08396__M
augagcaacaugacccagcugaccgaggcccagaucaucgccaucaucaaggacuggaacuucgccuggagccugaucuuccugcugaucaccaucgugcugcaguacggcuaccccagcagaagcaugaccguguacguguucaagauguucgugcuguggcugcuguggcccagcagcauggcccugagcaucuucagcgccaucuaccccaucgaccuggccagccagaucaucagcggcaucguggccgccgugagcgccaugauguggaucagcuacuucgugcagagcaucagacuguucaugagaaccggcagcugguggagcuucaaccccgagaccaacugccugcugaacgugcccuucggcggcaccaccguggugagaccccugguggaggacagcaccagcgugaccgccguggugaccaacggccaccugaagauggccggcaugcacuucggcgccugcgacuacgacagacugcccaacgaggugaccguggccaagcccaacgugcugaucgcccugaagauggugaagagacagagcuacggcaccaacagcggcguggccaucuaccacagauacaaggccggcaacuacagaagcccccccaucaccgccgacaucgagcuggcccugcugagagccuga

SEQ ID NO: 872 - RNA, 660 nt, Artificial Sequence
  derived and/or modified CDS sequence (opt4) from MERS-CoV__AGV08590__M
augagcaacaugacccagcugaccgaggcccagaucaucgccaucaucaaggacuggaacuucguguggagccugaucuuccugcugaucaccaucgugcugcaguacggcuaccccagcagaagcaugaccguguacguguucaagauguucgugcuguggcugcuguggcccagcagcauggcccugagcaucuucagcgccguguaccccaucgaccuggccagccagaucaucagcggcaucguggccgccgugagcgccaugauguggaucagcuacuucgugcagagcaucagacuguucaugagaaccggcagcugguggagcuucaaccccgagaccaacugccugcugaacgugcccuucggcggcaccaccguggugagaccccugguggaggacagcaccagcgugaccgccguggugaccaacggccaccugaagauggccggcaugcacuucggcgccugcgacuacgacagacugcccaacgaggugaccguggccaagcccaacgugcugaucgcccugaagauggugaagagacagagcuacggcaccaacagcggcguggccaucuaccacagauacaaggccggcaacuacagaagcccccccaucaccgccgacaucgagcuggcccugcugagagccuga

SEQ ID NO: 873 - RNA, 660 nt, Artificial Sequence
  derived and/or modified CDS sequence (opt4) from MERS-CoV__AHI48567__M
augagcaacaugacccagcuggccgaggcccagaucaucgccaucaucaaggacuggaacuucgccuggagccugaucuuccugcugaucaccaucgugcugcaguacggcuaccccagcagaagcaugaccguguacguguucaagauguucgugcuguggcugcuguggcccagcagcauggcccugagcaucuucagcgccguguaccccaucgaccuggccagccagaucaucagcggcaucguggccgccgugagcgccaugauguggaucagcuacuucgugcagagcaucagacuguucaugagaaccggcagcugguggagcuucaaccccgagaccaacugccugcugaacgugcccuucggcggcaccaccguggugagaccccugguggaggacagcaccagcgugaccgccguggugaccaacggccaccugaagauggccggcaugcacuucggcgccugcgacuacgacagacugcccaacgaggugaccguggccaagcccaacgugcugaucgcccugaagauggugaagagacagagcuacggcaccaacagcggcguggccaucuaccacagauacaaggccggcaacuacagaagcccccccaucaccgccgacaucgagcuggcccugcugagagccuga

SEQ ID NO: 874 - RNA, 660 nt, Artificial Sequence
  derived and/or modified CDS sequence (opt4) from MERS-CoV__AHI48589__M
augagcaacaugacccagcugaccgaggcccagaucaucgccgugaucaaggacuggaacuucgccuggagccugaucuuccugcugaucaccaucgugcugcaguacggcuaccccagcagaagcaugaccguguacguguucaagauguucgugcuguggcugcuguggcccagcagcauggcccugagcaucuucagcgccaucuaccccaucgaccuggccagccagaucaucagcggcaucguggccgccgugagcgccaugauguggaucagcuacuucgugcagagcaucagacuguucaugagaaccggcagcugguggagcuucaaccccgagaccaacugccugcugaacgugcccuucggcggcaccaccguggugagaccccugguggaggacagcaccagcgugaccgccguggugaccaacggccaccugaagauggccggcaugcacuucggcgccugcgacuacgacagacugcccaacgaggugaccguggccaagcccaacgugcugaucgcccugaagauggugaagagacagagcuacggcaccaacagcggcguggccaucuaccacagauacaaggccggcaacuacagaagcccccccaucaccgccgacaucgagcuggcccugcugagagccuga

SEQ ID NO: 875 - RNA, 660 nt, Artificial Sequence
  derived and/or modified CDS sequence (opt4) from MERS-CoV__AIL23940__M
augagcaacaugacccagcugaccgaggcccagaucaucgccaucaucaaggacuggaacuucgccuggagccugaucuuccugcugaucaccaucgugcugcaguacggcuaccccagcagaagcaugaccguguacguguucaagauguucgugcuguggcugcuguggcccagcagcauggcccugagcaucuucagcgccaucuaccccaucgaccuggccagccagaucaucagcggcaucguggccgccgugagcgccaugauguggaucagcuacuucgugcagagcaucagacuguucaugagaaccggcagcugguggagcuucaaccccgagaccaacugccugcugaacgugcccuucggcggcaccaccguggugagaccccugguggaggacagcaccagcgugaccgccguggugaccaacggccaccugaagauggccggcaugcacuucggcgccugcgacuacgacagacugcccaacgaggugaccguggccaagcccaacguggugaucgcccugaagauggugaagagacagagcuacggcaccaacagcggcguggccaucuaccacagauacaaggccggcaacuacagaagcccccccaucaccgccgacaucgagcuggcccugcugagagccuga

SEQ ID NO: 876 - RNA, 660 nt, Artificial Sequence
  derived and/or modified CDS sequence (opt4) from MERS-CoV__AKM76245__M
augagcaacaucacccagcugaccgaggcccagaucaucgccaucaucaaggacuggaacuucgccuggagccugaucuuccugcugaucaccaucgugcugcaguacggcuaccccagcagaagcaugaccguguacguguucaagauguucgugcuguggcugcuguggcccagcagcauggcccugagcaucuucagcgccguguaccccaucgaccuggccagccagaucaucagcggcaucguggccgccgugagcgccaugauguggaucagcuacuucgugcagagcaucagacuguucaugagaaccggcagcugguggagcuucaaccccgagaccaacugccugcugaacgugcccuucggcggcaccaccguggugagaccccugguggaggacagcaccagcgugaccgccguggugaccaacggccaccugaagauggccggcaugcacuucggcgccugcgacuacgacagacugcccaacgaggugaccguggccaagcccaacgugcugaucgcccugaagauggugaagagacagagcuacggcaccaacagcggcguggccaucuaccacagauacaaggccggcaacuacagaagcccccccaucaccgccgacaucgagcuggcccugcugagagccuga

SEQ ID NO: 877 - RNA, 660 nt, Artificial Sequence
  derived and/or modified CDS sequence (opt4) from MERS-CoV__ALW82726__M
augagcaacaugacccagcugaccgaggcccagaucaucgccaucaucaaggacuggcacuucgccuggagccugaucuuccugcugaucaccaucgugcugcaguacggcuaccccagcagaagcaugaccguguacguguucaagauguucgugcuguggcugcuguggcccagcagcauggcccugagcaucuucagcgccaucuaccccaucgaccuggccagccagaucaucagcggcaucguggccgccgugagcgccaugauguggaucagcuacuucgugcagagcaucagacuguucaugagaaccggcagcugguggagcuucaaccccgagaccaacugccugcugaacgugcccaucggcggcaccaccguggugagaccccugguggaggacagcaccagcgugaccgccguggugaccaacggccaccugaagauggccggcaugcacuucggcgccugcgacuacgacagacugcccaacgaggugaccguggccaagcccaacgugcugaucgcccugaagauggugaagagacagagcuacggcaccaacagcggcguggccaucuaccacagauacaaggccggcaacuacagaagcccccccaucaccgccgacaucgagcuggcccugcugagagccuga

SEQ ID NO: 878 - RNA, 660 nt, Artificial Sequence
  derived and/or modified CDS sequence (opt4) from MERS-CoV__ALX27238__M
augagcaacaugacccagcugaccgaggcccagaucaucgccaucaucaaggacuggagcuucgccuggagccugaucuuccugcugaucaccaucgugcugcaguacggcuaccccagcagaagcaugaccguguacguguucaagauguucgugcuguggcugcuguggcccagcagcauggcccugagcaucuucagcgccguguaccccaucgaccuggccagccagaucaucagcggcaucguggccgccgugagcgccaugauguggaucagcuacuucgugcagagcaucagacuguucaugagaaccggcagcugguggagcuucaaccccgagaccaacugccugcugaacgugcccuucggcggcaccaccguggugagaccccugguggaggacagcaccagcgugaccgccguggugaccaacggccaccugaagauggccggcaugcacuucggcgccugcgacuacgacagacugcccaacgaggugaccguggccaagcccaacgugcugaucgcccugaagauggugaagagacagagcuacggcaccaacagcggcguggccaucuaccacagauacaaggccggcaacuacagaagcccccccaucaccgccgacaucgagcuggcccugcugagagccuga

SEQ ID NO: 879 - RNA, 660 nt, Artificial Sequence
  derived and/or modified CDS sequence (opt4) from MERS-CoV__AMQ49021__M
augagcaacaugacccagcugaccgaggcccagaucaucgccaucaucaaggacuggcacuucgccuggagccugaucuuccugcugaucaccaucgugcugcaguacggcuaccccagcagaagcaugaccguguacguguucaagauguucgugcuguggcugcuguggcccagcagcauggcccugagcaucuucagcgccaucuaccccaucgaccuggccagccagaucaucagcggcaucguggccgccgugagcgccaugauguggaucagcuacuucgugcagagcaucagacuguucaugagaaccggcagcugguggagcuucaaccccgagaccaacugccugcugaacgugcccaucggcggcaccaccguggugagaccccugguggaggacagcaccagcgugaccgccguggugaccaacggccaccugaagauggccggcaugcacuucggcgccugcgacuacgacagacugagcaacgaggugaccguggccaagcccaacgugcugaucgcccugaagauggugaagagacagagcuacggcaccaacagcggcguggccaucuaccacagauacaaggccggcaacuacagaagcccccccaucaccgccgacaucgagcuggcccugcugagagccuga

SEQ ID NO: 880 - RNA, 660 nt, Artificial Sequence
  derived and/or modified CDS sequence (opt4) from MERS-CoV__AJG44108__M
augagcaacaugacccagcugaccgaggcccagaucaucgccaucaucaaggacuggaacuucgccuggagccugaucuuccugcugaucaccaucgugcugcaguacggcuaccccagcagaagcaugaccguguacguguucaagauguucgugcuguggcugcuguggcccagcagcauggcccugagcaucuucagcgccuucuaccccaucgaccuggccagccagaucaucagcggcaucguggccgccgugagcgccaugauguggaucagcuacuucgugcagagcaucagacuguucaugagaaccggcagcugguggagcuucaaccccgagaccaacugccugcugaacgugcccuucggcggcaccaccguggugagaccccugguggaggacagcaccagcgugaccgccguggugaccaacggccaccugaagauggccggcaugcacuucggcgccugcgacuacgacagacugcccaacgaggugaccguggccaagcccaacgugcugaucgcccugaagauggugaagagacagagcuacggcaccaacagcggcguggccaucuaccacagauacaaggccggcaacuacagaagcccccccaucaccgccgacaucgagcuggcccugcugagagccuga

SEQ ID NO: 881 - RNA, 660 nt, Artificial Sequence
  derived and/or modified CDS sequence (opt4) from MERS-CoV__ALA49369__M
augagcaacaugacccagcugaccgaggcccagaucaucgccaucaucaaggacuggaacuucgccuggagccugaucuuccugcugaucaccaucgugcugcaguacggcuaccccagcagaagcaugaccguguacguguucaagauguucgugcuguggcugcuguggcccagcagcauggcccugagcaucuucagcgccaucuaccccaucgaccuggccagccagaucaucagcggcaucguggccgccgugagcgccaugauguggaucagcuacuucgugcagagcaucagacuguucaugagaaccggcagcugguggagcuucaaccccgagaccaacugccugcugaacgugcccaucggcggcaccaccguggugagaccccugguggaggacagcaccagcgugaccgccguggugaccaacggccaccugaagauggccggcaugcacuucggcgccugcgacuacgacagacugcccaacgaggugaccguggccaagcccaacgugcugaucgcccugaagauggugaagagacagagcuacggcaccaacagcggcguggccaucuaccacagauacaaggccggcaacuacagaagcccccccaucaccgccgacaucgagcuggcccugcugagagccuga

SEQ ID NO: 882 - RNA, 660 nt, Artificial Sequence
  derived and/or modified CDS sequence (opt4) from MERS-CoV__ALA49424__M
augagcaacaugacccagcugaccgaggcccagaucaucgccaucaucaaggacuggaacuucgccuggagccugaucuuccugcugaucaccaucgugcugcaguacggcuaccccagcagaagcaugaccguguacguguucaagauguucgugcuguggcugcuguggcccagcagcauggcccugagcaucuucagcgccaucuaccccaucgaccuggccagccagaucaucagcggcaucguggccgccgugagcgccaugaugagaaucagcuacuucgugcagagcaucagacuguucaugagaaccggcagcugguggagcuucaaccccgagaccaacugccugcugaacgugcccuucggcggcaccaccguggugagaccccugguggaggacagcaccagcgugaccgccguggugaccaacggccaccugaagauggccggcaugcacuucggcgccugcgacuacgacagacugcccaacgaggugaccguggccaagcccaacgugcugaucgcccugaagauggugaagagacagagcuacggcaccaacagcggcguggccaucuaccacagauacaaggccggcaacuacagaagcccccccaucaccgccgacaucgagcuggcccugcugagagccuga

SEQ ID NO: 883 - RNA, 660 nt, Artificial Sequence
  derived and/or modified CDS sequence (opt4) from MERS-CoV__ALA49908__M
augagcaacaugacccagcugaccgaggcccagaucaucgccaucaucaaggacuggaacuucgccuggagccugaucuuccugcugaucaccaucgugcugcaguacggcuaccccagcagaagcaugaccguguacguguucaagauguucgugcuguggcugcuguggcccagcagcauggcccugagcaucuucagcgccaucuaccccaucgaccugagcagccagaucaucagcggcaucguggccgccgugagcgccaugauguggaucagcuacuucgugcagagcaucagacuguucaugagaaccggcagcugguggagcuucaaccccgagaccaacugccugcugaacgugcccuucggcggcaccaccguggugagaccccugguggaggacagcaccagcgugaccgccguggugaccaacggccaccugaagauggccggcaugcacuucggcgccugcgacuacgacagacugcccaacgaggugaccguggccaagcccaacgugcugaucgcccugaagauggugaagagacagagcuacggcaccaacagcggcguggccaucuaccacagauacaaggccggcaacuacagaagcccccccaucaccgccgacaucgagcuggcccugcugagagccuga

SEQ ID NO: 884 - RNA, 660 nt, Artificial Sequence
  derived and/or modified CDS sequence (opt4) from MERS-CoV__ALA49963__M
augagcaacaugacccagcugaccgaggcccagaucaucgccaucaucaaggacuggaacuucgccuggagccugaucuuccugcugaucaccaucgugcugcaguacggcuaccccagcagaagcaugaccguguacguguucaagauguucgugcuguggcugcuguggcccagcagcauggcccugagcaucuucagcgccaucuaccccaucgaccuggccagccagaucaucagcggcaucguggccgccgugagcgccaugauguggaucagcuacuucgugcagagcaucagacuguucaugagaaccggcagcugguggagcuucaaccccgagaccaacugccugcugaacgugcccaucggcggcaccaccguggugagaccccugguggaggacagcaccagcgugaccgccguggugaccaacggccaccugaagauggccggcaugcacuucggcgccugcgacuacgacagacugagcaacgaggugaccguggccaagcccaacgugcugaucgcccugaagauggugaagagacagagcuacggcaccaacagcggcguggccaucuaccacagauacaaggccggcaacuacagaagcccccccaucaccgccgacaucgagcuggcccugcugagagccuga

SEQ ID NO: 885 - RNA, 1242 nt, Artificial Sequence
  derived and/or modified CDS sequence (opt4) from MERS-CoV__AFS88943__N
auggccagccccgccgcccccagagccgugagcuucgccgacaacaacgacaucaccaacaccaaccugagcagaggcagaggcagaaaccccaagcccagagccgcccccaacaacaccgugagcugguacaccggccugacccagcacggcaaggugccccugaccuucccccccggccagggcgugccccugaacgccaacagcacccccgcccagaacgccggcuacuggagaagacaggacagaaagaucaacaccggcaacggcaucaagcagcuggcccccagaugguacuucuacuacaccggcaccggccccgaggccgcccugcccuucagagccgugaaggacggcaucgugugggugcacgaggacggcgccaccgacgcccccagcaccuucggcaccagaaaccccaacaacgacagcgccaucgugacccaguucgcccccggcaccaagcugcccaagaacuuccacaucgagggcaccggcggcaacagccagagcagcagcagagccagcagccugagcagaaacagcagcagaagcagcagccagggcagcagaagcggcaacagcaccagaggcaccagccccggccccagcggcaucggcgccgugggcggcgaccugcuguaccuggaccugcugaacagacugcaggcccuggagagcggcaaggugaagcagagccagcccaaggugaucaccaagaaggacgccgccgccgccaagaacaagaugagacacaagagaaccagcaccaagagcuucaacauggugcaggccuucggccugagaggccccggcgaccugcagggcaacuucggcgaccugcagcugaacaagcugggcaccgaggaccccagauggccccagaucgccgagcuggcccccaccgccagcgccuucaugggcaugagccaguucaagcugacccaccagaacaacgacgaccacggcaaccccguguacuuccugagauacagcggcgccaucaagcuggaccccaagaaccccaacuacaacaaguggcuggagcugcuggagcagaacaucgacgccuacaagaccuuccccaagaaggagaagaagcagaaggcccccaaggaggagagcaccgaccagaugagcgagccccccaaggagcagagagugcagggcagcaucacccagagaaccagaaccagacccagcgugcagcccggccccaugaucgacgugaacaccgacuga

SEQ ID NO: 886 - RNA, 1236 nt, Artificial Sequence
  derived and/or modified CDS sequence (opt4) from MERS-CoV__AFY13314__N
auggccagccccgccgcccccagagccgugagcuucgccgacaacaacgacaucaccaacaccaaccugagcagaggcagaggcagaaaccccaagcccagagccgcccccaacaacaccgugagcugguacaccggccugacccagcacggcaaggugccccugaccuucccccccggccagggcgugccccugaacgccaacagcacccccgcccagaacgccggcuacuggagaagacaggacagaaagaucaacaccggcaacggcaucaagcagcuggcccccagaugguacuucuacuacaccggcaccggccccgaggccgcccugcccuucagagccgugaaggacggcaucgugugggugcacgaggacggcgccaccgacgcccccagcaccuucggcaccagaaaccccaacaacgacagcgccaucgugacccaguucgcccccggcaccaagcugcccaagaacuuccacaucgagggcaccggcggcaacagccagagcagcagcagagccagcagcgugagcagaaacagcagcagaagcagcagccagggcagcagaagcggcaacagcaccagaggcaccagccccggccccagcggcaucggcgccgugggcggcgaccugcuguaccuggaccugcugaacagacugcaggcccuggagagcggcaaggugaagcagagccagcccaaggugaucaccaagaaggacgccgccgccgccaagaacaagaugagacacaagagaaccagcaccaagagcuucaacauggugcaggccuucggccugagaggccccggcgaccugcagggcaacuucggcgaccugcagcugaacaagcugggcaccgaggaccccagauggccccagaucgccgagcuggcccccaccgccagcgccuucaugggcaugagccaguucaagcugacccaccagaacaacgacgaccacggcaaccccguguacuuccugagauacagcggcgccaucaagcuggaccccaagaaccccaacuacaacaaguggcuggagcugcuggagcagaacaucgacgccuacaagaccuuccccaagaaggagaagaagcagaaggcccccaaggaggagagcaccgaccagaugagcgagccccccaaggagcacagagugcagggcacccagagaaccagaaccagacccagcgugcagcccggccccaugaucgacgugaacaccgacuga

SEQ ID NO: 887 - RNA, 1242 nt, Artificial Sequence
  derived and/or modified CDS sequence (opt4) from MERS-CoV__AGH58724__N
auggccagccccgccgcccccagagccgugagcuucgccuacaacaacgacaucaccaacaccaaccugagcagaggcagaggcagaaaccccaagcccagagccgcccccaacaacaccgugagcugguacaccggccugacccagcacggcaaggugccccugaccuucccccccggccagggcgugccccugaacgccaacagcacccccgcccagaacgccggcuacuggagaagacaggacagaaagaucaacaccggcaacggcaucaagcagcuggcccccagaugguacuucuacuacaccggcaccggccccgaggccgcccugcccuucagagccgugaaggacggcaucgugugggugcacgaggacggcgccaccgacgcccccagcaccuucggcaccagaaaccccaacaacgacagcgccaucgugacccaguucgcccccggcaccaagcugcccaagaacuuccacaucgagggcaccggcggcaacagccagagcagcagcagagccagcagcgugagcagaaacagcagcagaagcagcagccagggcagcagaagcggcaacagcaccagaggcaccagccccggccccagcggcaucggcgccgugggcggcgaccugcuguaccuggaccugcugaacagacugcaggcccuggagagcggcaaggugaagcagagccagcccaaggugaucaccaagaaggacgccgccgccgccaagaacaagaugagacacaagagaaccagcaccaagagcuucaacauggugcaggccuucggccugagaggccccggcgaccugcagggcaacuucggcgaccugcagcugaacaagcugggcaccgaggaccccagauggccccagaucgccgagcuggcccccaccgccagcgccuucaugggcaugagccaguucaagcugacccaccagaacaacgacgaccacggcaaccccguguacuuccugagauacagcggcgccaucaagcuggaccccaagaaccccaacuacaacaaguggcuggagcugcuggagcagaacaucgacgccuacaagaccuuccccaagaaggagaagaagcagaaggcccccaaggaggagagcaccgaccagaugagcgagccccccaaggagcagagagugcagggcagcaucacccagagaaccagaaccagacccagcgugcagcccggccccaugaucgacgugaacaccgacuga

SEQ ID NO: 888 - RNA, 1242 nt, Artificial Sequence
  derived and/or modified CDS sequence (opt4) from MERS-CoV__AGV08397__N
auggccagccccgccgcccccagagccgugagcuucgccgacaacaacgacaucaccaacaccaaccugagcagaggcagaggcagaaaccccaagcccagagccgcccccaacaacaccgugagcugguacaccggccugacccagcacggcaaggugccccugaccuucccccccggccagggcgugccccugaacgccaacagcacccccgcccagaacgccggcuacuggagaagacaggacagaaagaucaacaccggcaacggcaucaagcagcuggcccccagaugguacuucuacuacaccggcaccggccccgaggccgcccugcccuucagagccgugaaggacggcaucgugugggugcacgaggacggcgccaccgacgcccccagcaccuucggcaccagaaaccccaacaacgacagcgccaucgugacccaguucgcccccggcaccaagcugcccaagaacuuccacaucgagggcaccggcggcaacagccagagcagcagcagagccagcagcgugagcagaaacagcagcagaagcagcagccagggcagcagaagcggcaacagcaccagaggcaccagccccggccccagcggcaucggcgccgugggcggcgaccugcuguaccuggaccugcugaacagacugcaggcccuggagagcggcaaggugaagcagagccagcccaaggugaucaccaagaaggacgccgccgccgccaagaacaagaugagacacaagagaaccagcaccaagagcuucaacauggugcaggccuucggccugagaggccccggcgaccugcagggcaacuucggcgaccugcagcugaacaagcugggcaccgaggaccccagauggccccagaucgccgagcuggcccccaccgccagcgccuucaugggcaugagccaguucaagcugacccaccagaacaacgacgaccacggcaaccccguguacuuccugagauacagcggcgccaucaagcuggaccccaagaaccccaacuacaacaaguggcuggagcugcuggagcagaacaucgacgccuacaagaccuuccccaagaaggagaagaagcagaaggcccccaaggaggagcugaccgaccagaugagcgagccccccaaggagcagagagugcagggcagcaucacccagagaaccagaaccagacccagcgugcagcccggccccaugaucgacgugaacaccgacuga

SEQ ID NO: 889 - RNA, 1242 nt, Artificial Sequence
  derived and/or modified CDS sequence (opt4) from MERS-CoV__AGV08415__N
auggccagccccgccgcccccagagccgugagcuucgccgacaacaacgacaucaccaacaccaaccugagcagaggcagaggcagaaaccccaagcccagagccgcccccaacaacaccgugagcugguacaccggccugacccagcacggcaaggugccccugaccuucccccccggccagggcgugccccugaacgccaacagcacccccgcccagaacgccggcuacuggagaagacaggacagaaagaucaacaccggcaacggcaucaagcagcuggcccccagaugguacuucuacuacaccggcaccggccccgaggccgcccugcccuucagagccgugaaggacggcaucgugugggugcacgaggacggcgccaccgacgcccccagcaccuucggcaccagaaaccccaacaacgacagcgccaucgugacccaguucgcccccggcaccaagcugcccaagaacuuccacaucgagggcaccggcggcaacagccagagcagcagcagagccagcagcgugagcagaaacagcagcagaagcagcagccagggcagcagaagcggcaacagcaccagaggcaccagccccggccccagcggcaucggcgccgugggcggcgaccugcuguaccuggaccugcugaacagacugcaggcccuggagagcggcaaggugaagcagagccagcccaaggugaucaccaagaaggacgccgccgccgccaagaacaagaugagacacaagagaaccagcaccaagagcuucaacauggugcaggccuucggccugagaggccccggcgaccugcagggcaacuucggcgaccugcagcugaacaagcugggcaccgaggaccccagauggccccagaucgccgagcuggcccccaccgccagcgccuucaugggcaugagccaguucaagcugacccaccagaacaacgacgaccacggcaaccccguguacuuccugagauacagcggcgccaucaagcuggaccccaagaaccccaacuacaacaaguggcuggagcugcuggagcagaacaucgacgccuacaagaccuuccccaagaaggagaagaagcagaaggcccccaaggaggagagcaccgaccagaugagcgagccccccaaggagcagagagugcagggcagcaucacccagagaaccagaaccagacccagcgugcagcccggccccaugaucgacgugaacaccgacuga

SEQ ID NO: 890 - RNA, 1242 nt, Artificial Sequence
  derived and/or modified CDS sequence (opt4) from MERS-CoV__AGV08487__N
auggccagccccgccgcccccagagccgugagcuucgccgacaacaacgacaucaccaacaccaaccugagcagaggcagaggcagaaaccccaagcccagagccgcccccaacaacaccgugagcugguacaccggccugacccagcacggcaaggugccccugaccuucccccccggccagggcgugccccugaacgccaacagcacccccgcccagaacgccggcuacuggagaagacaggacagaaagaucaacaccggcaacggcaucaagcagcuggcccccagaugguacuucuacuacaccggcaccggccccgaggccgcccugcccuucagagccgugaaggacggcaucgugugggugcacgagcacggcgccaccgacgcccccagcaccuucggcaccagaaaccccaacaacgacagcgccaucgugacccaguucgcccccggcaccaagcugcccaagaacuuccacaucgagggcaccggcggcaacagccagagcagcagcagagccagcagcgugagcagaaacagcagcagaagcagcagccagggcagcagaagcggcaacagcaccagaggcaccagccccggccccagcggcaucggcgccgugggcggcgaccugcuguaccuggaccugcugaacagacugcaggcccuggagagcggcaaggugaagcagagccagcccaaggugaucaccaagaaggacgccgccgccgccaagaacaagaugagacacaagagaaccagcaccaagagcuucaacauggugcaggccuucggccugagaggccccggcgaccugcagggcaacuucggcgaccugcagcugaacaagcugggcaccgaggaccccagauggccccagaucgccgagcuggcccccaccgccagcgccuucaugggcaugagccaguucaagcugacccaccagaacaacgacgaccacggcaaccccguguacuuccugagauacagcggcgccaucaagcuggaccccaagaaccccaacuacaacaaguggcuggagcugcuggagcagaacaucgacgccuacaagaccuuccccaagaaggagaagaagcagaaggcccccaaggaggagagcaccgaccagaugagcgagccccccaaggagcagagagugcagggcagcaucacccagagaaccagaaccagacccagcgugcagcccggccccaugaucgacgugaacaccgacuga

SEQ ID NO: 891 - RNA, 1242 nt, Artificial Sequence
  derived and/or modified CDS sequence (opt4) from MERS-CoV__AHC74095__N
auggccagccccgccgcccccagagccgugagcuucgccgacaacaacgacaucaccaacaccaaccugagcagaggcagaggcagaaaccccaagcccagagccgcccccaacaacaccgugagcugguacaccggccugacccagcacggcaaggugccccugaccuucccccccggccagggcgugccccugaacgccaacagcacccccgcccagaacgccggcuacuggagaagacaggacagaaagaucaacaccggcaacggcaucaagcagcuggcccccagaugguacuucuacuacaccggcaccggccccgaggccgcccugcccuucagagccgugaaggacggcaucgugugggugcacgaggacggcgccaccgacgcccccagcaccuucggcaccagaaaccccaacaacgaccuggccaucgugacccaguucgcccccggcaccaagcugcccaagaacuuccacaucgagggcaccggcggcaacagccagagcagcagcagagccagcagcgugagcagaaacagcagcagaagcagcagccagggcagcagaagcggcaacagcaccagaggcaccagccccggccccagcggcaucggcgccgugggcggcgaccugcuguaccuggaccugcugaacagacugcaggcccuggagagcggcaaggugaagcagagccagcccaaggugaucaccaagaaggacgccgccgccgccaagaacaagaugagacacaagagaaccagcaccaagagcuucaacauggugcaggccuucggccugagaggccccggcgaccugcagggcaacuucggcgaccugcagcugaacaagcugggcaccgaggaccccagauggccccagaucgccgagcuggcccccaccgccagcgccuucaugggcaugagccaguucaagcugacccaccagaacaacgacgaccacggcaaccccguguacuuccugagauacagcggcgccaucaagcuggaccccaagaaccccaacuacaacaaguggcuggagcugcuggagcagaacaucgacgccuacaagaccuuccccaagaaggagaagaagcagaaggcccccaaggaggagagcaccgaccagaugagcgagccccccaaggagcagagagugcagggcagcaucacccagagaaccagaaccagacccagcgugcagcccggccccaugaucgacgugaacaccgacuga

SEQ ID NO: 892 - RNA, 1242 nt, Artificial Sequence
  derived and/or modified CDS sequence (opt4) from MERS-CoV__AHI48535__N
auggccagccccgccgcccccagagccgugagcuucgccgacaacaacgacaucaccaacaccaaccugagcagaggcagaggcagaaaccccaagcccagagccgcccccaacaacaccgugagcugguacaccggccugacccagcacggcaaggugccccugaccuucagccccggccagggcgugccccugaacgccaacagcacccccgcccagaacgccggcuacuggagaagacaggacagaaagaucaacaccggcaacggcaucaagcagcuggcccccagaugguacuucuacuacaccggcaccggccccgaggccgcccugcccuucagagccgugaaggacggcaucgugugggugcacgaggacggcgccaccgacgcccccagcaccuucggcaccagaaaccccaacaacgacagcgccaucgugacccaguucgcccccggcaccaagcugcccaagaacuuccacaucgagggcaccggcggcaacagccagagcagcagcagagccagcagcgugagcagaaacagcagcagaagcagcagccagggcagcagaagcggcaacagcaccagaggcaccagccccggccccagcggcaucggcgccgugggcggcgaccugcuguaccuggaccugcugaacagacugcaggcccuggagagcggcaaggugaagcagagccagcccaaggugaucaccaagaaggacgccgccgccgccaagaacaagaugagacacaagagaaccagcaccaagagcuucaacauggugcaggccuucggccugagaggccccggcgaccugcagggcaacuucggcgaccugcagcugaacaagcugggcaccgaggaccccagauggccccagaucgccgagcuggcccccaccgccagcgccuucaugggcaugagccaguucaagcugacccaccagaacaacgacgaccacggcaaccccguguacuuccugagauacagcggcgccaucaagcuggaccccaagaaccccaacuacaacaaguggcuggagcugcuggagcagaacaucgacgccuacaagaccuuccccaagaaggagaagaagcagaaggcccccaaggaggagagcaccgaccaggugagcgagccccccaaggagcagagagugcagggcaucaucacccagagaaccagaaccagacccagcgugcagcccggccccaugaucgacgugaacaccgacuga

SEQ ID NO: 893 - RNA, 1242 nt, Artificial Sequence
  derived and/or modified CDS sequence (opt4) from MERS-CoV__AIL23941__N
auggccagccuggccgcccccagagccgugagcuucgccgacaacaacgacaucaccaacaccaaccugagcagaggcagaggcagaaaccccaagcccagagccgcccccaacaacaccgugagcugguacaccggccugacccagcacggcaaggugccccugaccuucccccccggccagggcgugccccugaacgccaacagcacccccgcccagaacgccggcuacuggagaagacaggacagaaagaucaacaccggcaacggcaucaagcagcuggcccccagaugguacuucuacuacaccggcaccggccccgaggccgcccugcccuucagagccgugaaggacggcaucgugugggugcacgagcacggcgccaccgacgcccccagcaccuucggcaccagaaaccccaacaacgacagcgccaucgugacccaguucgcccccggcaccaagcugcccaagaacuuccacaucgagggcaccggcggcaacagccagagcagcagcagagccagcagcgugagcagaaacagcagcagaagcagcagccagggcagcagaagcggcaacagcaccagaggcaccagccccggccccagcggcaucggcgccgugggcggcgaccugcuguaccuggaccugcugaacagacugcaggcccuggagagcggcaaggugaagcagagccagcccaaggugaucaccaagaaggacgccgccgccgccaagaacaagaugagacacaagagaaccagcaccaagagcuucaacauggugcaggccuucggccugagaggccccggcgaccugcagggcaacuucggcgaccugcagcugaacaagcugggcaccgaggaccccagauggccccagaucgccgagcuggcccccaccgccagcgccuucaugggcaugagccaguucaagcugacccaccagaacaacgacgaccacggcaaccccguguacuuccugagauacagcggcgccaucaagcuggaccccaagaaccccaacuacaacaaguggcuggagcugcuggagcagaacaucgacgccuacaagaccuuccccaagaaggagaagaagcagaaggcccccaaggaggagagcaccgaccagaugagcgagccccccaaggagcagagagugcagggcagcaucacccagagaaccagaaccagacccagcgugcagcccggccccaugaucgacgugaacaccgacuga

SEQ ID NO: 894 - RNA, 1242 nt, Artificial Sequence
  derived and/or modified CDS sequence (opt4) from MERS-CoV__AIL23996__N
auggccagccccgccgcccccagagccgugagcuucgccgacaacaacgacaucaccaacaccaaccugagcagaggcagaggcagaaaccccaagcccagagccgcccccaacaacaccgugagcugguacaccggccugacccagcacggcaaggugccccugaccuucccccccggccagggcgugccccugaacgccaacagcacccccgcccagaacgccggcuacuggagaagacaggacagaaagaucaacaccggcaacggcaucaagcagcuggcccccagaugguacuucuacuacaccggcaccggccccgaggccgcccugcccuucagagccgugaaggacggcaucgugugggugcacgaggacggcgccaccgacgcccccagcaccuucggcaccagaaaccccaacaacgaccuggccaucgugacccaguucgcccccggcaccaagcugcccaagaacuuccacaucgagggcaccggcggcaacagccagagcagcagcagagccagcagcgugagcagaaacagcagcagaagcagcagccagggcagcagaagcggcaacagcaccagaggcaccagccccggccccagcggcaucggcgccgugggcggcgaccugcuguaccuggaccugcugaacagacugcaggcccuggagagcggcaaggugaagcagagccagcccaaggugaucaccaagaaggacgccgccgccgccaagaacaagaugagacacaagagaaccagcaccaagagcuucaacauggugcaggccuucggccugagaggccccggcgaccugcagggcaacuucggcgaccugcagcugaacaagcugggcaccgaggaccccagauggccccagaucgccgagcuggcccccaccgccagcgccuucaugggcaugagccaguucaagcugacccaccagaacaacgacgaccacggcaaccccguguacuuccugagauacagcggcgccaucaagcuggaccccaagaaccccaacuacaacaaguggcuggagcugcuggagcagaacaucgacgccuacaagaccuuccccaagaaggagaagaagcagaaggcccccaaggaggagagcaccgaccagaugagcgagccccccaaggagcagagagugcagggcagcaucacccagcacaccagaaccagacccagcgugcagcccggccccaugaucgacgugaacaccgacuga

SEQ ID NO: 895 - RNA, 1242 nt, Artificial Sequence
  derived and/or modified CDS sequence (opt4) from MERS-CoV__AIY60565__N
auggccgcccccgccgcccccagagccgugagcuucgccgacaacaacgacaucaccaacaccaaccugagcagaggcagaggcagaaaccccaagcccagagccgcccccaacaacaccgugagcugguacaccggccugacccagcacggcaaggugccccugaccuucccccccggccagggcgugccccugaacgccaacagcacccccgcccagaacgccggcuacuggagaagacaggacagaaagaucaacaccggcaacggcaucaagcagcuggcccccagaugguacuucuacuacaccggcaccggccccgaggccgcccugcccuucagagccgugaaggacggcaucgugugggugcacgaggacggcgccaccgacgcccccagcaccuucggcaccagaaaccccaacaacgacagcgccaucgugacccaguucgcccccggcaccaagcugcccaagaacuuccacaucgagggcaccggcggcaacagccagagcagcagcagagccagcagcgugagcagaaacagcagcagaagcagcagccagggcagcagaagcggcaacagcaccagaggcaccagccccgugcccagcggcaucggcgccgugggcggcgaccugcuguaccuggaccugcugaacagacugcaggcccuggagagcggcaaggugaagcagagccagcccaaggugaucaccaagaaggacgccgccgccgccaagaacaagaugagacacaagagaaccagcaccaagagcuucaacauggugcaggccuucggccugagaggccccggcgaccugcagggcaacuucggcgaccugcagcugaacaagcugggcaccgaggaccccagauggccccagaucgccgagcuggcccccaccgccagcgccuucaugggcaugagccaguucaagcugacccaccagaacaacgacgaccacggcaaccccguguacuuccugagauacagcggcgccaucaagcuggaccccaagaaccccaacuacaacaaguggcuggagcugcuggagcagaacaucgacgccuacaagaccuuccccaagaaggagaagaagcagaaggcccccaaggaggagagcaccgaccagaugagcgagccccccaaggagcagagagugcagggcagcaucacccagagaaccagaaccagacccagcgugcagcccggccccaugaucgacgugaacaccgacuga

SEQ ID NO: 896 - RNA, 1242 nt, Artificial Sequence
  derived and/or modified CDS sequence (opt4) from MERS-CoV__AIZ74424__N
auggccgcccccgccgcccccagagccgugagcuucgccgacaacaacgacaucaccaacaccaaccugagcagaggcagaggcagaaaccccaagcccagagccgcccccaacaacaccgugagcugguacaccggccugacccagcacggcaaggugccccugaccuucccccccggccagggcgugccccugaacgccaacagcacccccgcccagaacgccggcuacuggagaagacaggacagaaagaucaacaccggcaacggcaucaagcagcuggcccccagaugguacuucuacuacaccggcaccggccccgaggccgcccugcccuucagagccgugaaggacggcaucgugugggugcacgaggacggcgccaccgacgcccccagcaccuucggcaccagaaaccccaacaacgacagcgccaucgugacccaguucgcccccggcaccaagcugcccaagaacuuccacaucgagggcaccggcggcaacagccagagcagcagcagagccagcagcgugagcagaaacagcagcagaagcagcagccagggcagcagaagcggcaacagcaccagaggcaccagccccggccccagcggcaucggcgccgugggcggcgaccugcuguaccuggaccugcugaacagacugcaggcccuggagagcggcaaggugaagcagagccagcccaaggugaucaccaagaaggacgccgccgccgccaagaacaagaugagacacaagagaaccagcaccaagagcuucaacauggugcaggccuucggccugagaggccccggcgaccugcagggcaacuucggcgaccugcagcugaacaagcugggcaccgaggaccccagauggccccagaucgccgagcuggcccccaccgccagcgccuucaugggcaugagccaguucaagcugacccaccagaacaacgacgaccacggcaaccccguguacuuccugagauacagcggcgccaucaagcuggaccccaagaaccccaacuacaacaaguggcuggagcugcuggagcagaacaucgacgccuacaagaccuuccccaagaaggagaagaagcagaaggcccccaaggaggagagcaccgaccagaugagcgagccccccaaggagcagagagugcagggcagcaucacccagagaaccagaaccagacccagcgugcagcccggccccaugaucgacgugaacaccgacuga

SEQ ID NO: 897 - RNA, 1242 nt, Artificial Sequence; identical to SEQ ID NO: 896
  derived and/or modified CDS sequence (opt4) from MERS-CoV__AIZ74430__N

SEQ ID NO: 898 - RNA, 1242 nt, Artificial Sequence
  derived and/or modified CDS sequence (opt4) from MERS-CoV__AKI29291__N
auggccagccccgccgcccccagagccgugagcuucgccgacaacaacgacaucaccaacaccaaccugagcagaggcagaggcagaaaccccaagcccagagccgcccccaacaacaccgugagcugguacaccggccugacccagcacggcaaggugccccugaccuucccccccggccagggcgugccccugaacgccaacagcacccccgcccagaacgccggcuacuggagaagacaggacagaaagaucaacaccggcaacggcaucaagcagcuggcccccagaugguacuucuacuacaccggcaccggccccgaggccgcccugcccuucagagccgugaaggacggcaucgugugggugcacgaggacggcgccaccgacgcccccagcaccuucggcaccagaaaccccaacaacgacagcgccaucgugacccaguucgcccccggcaccaagcugcccaagaacuuccacaucgagggcaccggcggcaacagccagagcagcagcagagccagcagcgugagcagaaacagcagcagaagcagcagccagggcagcagaagcggcaacagcaccagaggcaccagccccggccccagcggcaucggcgccgugggcggcgaccugcuguaccuggaccugcugaacagacugcaggcccuggagagcggcaaggugaagcagagccagcccaaggugaucaccaagaaggacgccgccgccgccaagaacaagaugagacacaagagaaccagcaccaagagcuucaacauggugcaggccuucggccugagaggccccggcgaccugcagggcaacuucggcgaccugcagcugaacaagcugggcaccgaggaccccagauggccccagaucgccgagcuggcccccaccgccagcgccuucaugggcaugagccaguucaagcugacccaccagaacaacgacgaccacggcaaccccguguacuuccugagauacagcggcgccaucaagcuggaccccaagaaccccaacuacaacaaguggcuggagcugcuggagcagaacaucgacgccuacaagaccuuccccaagaaggagaagaagcagaaggcccccaaggaggagagcaccgaccagaugagcgagccccccaaggagcagagagugcagggcagcaucacccagagaaucagaaccagacccagcgugcagcccggccccaugaucgacgugaacaccgacuga

SEQ ID NO: 899 - RNA, 1242 nt, Artificial Sequence
  derived and/or modified CDS sequence (opt4) from MERS-CoV__AKK52599__N
auggccagccccgccgcccccugcgccgugagcuucgccgacaacaacgacaucaccaacaccaaccugagcagaggcagaggcagaaaccccaagcccagagccgcccccaacaacaccgugagcugguacaccggccugacccagcacggcaaggugccccugaccuucccccccggccagggcgugccccugaacgccaacagcacccccgcccagaacgccggcuacuggagaagacaggacagaaagaucaacaccggcaacggcaucaagcagcuggcccccagaugguacuucuacuacaccggcaccggccccgaggccgcccugcccuucagagccgugaaggacggcaucgugugggugcacgaggacggcgccaccgacgcccccagcaccuucggcaccagaaaccccaacaacgacagcgccaucgugacccaguucgcccccggcaccaagcugcccaagaacuuccacaucgagggcaccggcggcaacagccagagcagcagcagagccagcagcgugagcagaaacagcagcagaagcagcagccagggcagcagaagcggcaacagcaccagaggcaccagccccggccccagcggcaucggcgccgugggcggcgaccugcuguaccuggaccugcugaacagacugcaggcccuggagagcggcaaggugaagcagagccagcccaaggugaucaccaagaaggacgccgccgccgccaagaacaagaugagacacaagagaaccagcaccaagagcuucaacauggugcaggccuucggccugagaggccccggcgaccugcagggcaacuucggcgaccugcagcugaacaagcugggcaccgaggaccccagauggccccagaucgccgagcuggcccccaccgccagcgccuucaugggcaugagccaguucaagcugacccaccagaacaacgacgaccacggcaaccccguguacuuccugagauacagcggcgccaucaagcuggaccccaagaaccccaacuacaacaaguggcuggagcugcuggagcagaacaucgacgccuacaagaccuuccccaagaaggagaagaagcagaaggcccccaaggaggagagcaccgaccagaugagcgagccccccaaggagcagagagugcagggcagcaucacccagagaaccagaaccagacccagcgugcagcccggccccaugaucgacgugaacaccgacuga

SEQ ID NO: 900 - RNA, 1242 nt, Artificial Sequence
  derived and/or modified CDS sequence (opt4) from MERS-CoV__AKN24774__N
auggccagccccgccgcccccagagccgugagcuucgccgacaacaacgacaucaccaacaccaaccugagcagaggcagaggcagaaaccccaagcccagagccgcccccaacaacaccgugagcugguacaccggccugacccagcacggcaaggugccccugaccuucccccccggccagggcgugccccugaacgccaacagcacccccgcccagaacgccggcuacuggagaagacaggacagaaagaucaacaccggcaacggcaucaagcagcuggcccccagaugguacuucuacuacaccggcaccggccccgaggccgcccugcccuucagagccgugaaggacggcaucgugugggugcacgaggacggcgccaccgacgcccccagcaccuucggcaccagaaaccccaacaacgaccuggccaucgugacccaguucgcccccggcaccaagcugcccaagaacuuccacaucgagggcaccggcggcaacagccagagcagcagcagagccagcagcgugagcagaaacagcagcagaagcagcagccagggcagcagaagcggcaacagcaccagaggcaccagccccggccccagcggcaucggcgccgugggcggcgaccugcuguaccuggaccugcugaacagacugcaggcccuggagagcggcaaggugaagcagagccagcccaaggugaucaccaagaaggacgccgccgccgccaagaacaagaugagacacaagagaaccagcaccaagagcuucaacauggugcaggccuucggccugagaggccccggcgaccugcagggcaacuucggcgaccugcagcugaacaagcugggcaccgaggaccccagauggccccagaucgccgagcuggugcccaccgccagcgccuucaugggcaugagccaguucaagcugacccaccagaacaacgacgaccacggcaaccccguguacuuccugagauacagcggcgccaucaagcuggaccccaagaaccccaacuacaacaaguggcuggagcugcuggagcagaacaucgacgccuacaagaccuuccccaagaaggagaagaagcagaaggcccccaaggaggagagcaccgaccagaugagcgagccccccaaggagcagagagugcagggcagcaucacccagcacaccagaaccagacccagcgugcagcccggccccaugaucgacgugaacaccgacuga

SEQ ID NO: 901 - RNA, 1242 nt, Artificial Sequence
  derived and/or modified CDS sequence (opt4) from MERS-CoV__ALW82676__N
auggccagccccgccgcccccagagccgugagcuucgccgacaacaacgacaccaccaacaccaaccugagcagaggcagaggcagaaaccccaagcccagagccgcccccaacaacaccgugagcugguacaccggccugacccagcacggcaaggugccccugaccuucccccccggccagggcgugccccugaacgccaacagcacccccgcccagaacgccggcuacuggagaagacaggacagaaagaucaacaccggcaacggcaucaagcagcuggcccccagaugguacuucuacuacaccggcaccggccccgaggccgcccugcccuucagagccgugaaggacggcaucgugugggugcacgaggacggcgccaccgacgcccccagcaccuucggcaccagaaaccccaacaacgacagcgccaucgugacccaguucgcccccggcaccaagcugcccaagaacuuccacaucgagggcaccggcggcaacagccagagcagcagcagagccagcagcgugagcagaaacagcagcagaagcagcagccagggcagcagaagcggcaacagcaccagaggcaccagccccggccccagcggcaucggcgccgugggcggcgaccugcuguaccuggaccugcugaacagacugcaggcccuggagagcggcaaggugaagcagagccagcccaaggugaucaccaagaaggacgccgccgccgccaagaacaagaugagacacaagagaaccagcaccaagagcuucaacauggugcaggccuucggccugagaggccccggcgaccugcagggcaacuucggcgaccugcagcugaacaagcugggcaccgaggaccccagauggccccagaucgccgagcuggcccccaccgccagcgccuucaugggcaugagccaguucaagcugacccaccagaacaacgacgaccacggcaaccccguguacuuccugagauacagcggcgccaucaagcuggaccccaagaaccccaacuacaacaaguggcuggagcugcuggagcagaacaucgacgccuacaagaccuuccccaagaaggagaagaagcagaaggcccccaaggaggagagcaccgaccagaugagcgagccccccaaggagcagagagugcagggcagcaucacccagagaaccagaaccagacccagcgugcagcccggccccaugaucgacgugaacaccgacuga

SEQ ID NO: 902 - RNA, 1242 nt, Artificial Sequence
  derived and/or modified CDS sequence (opt4) from MERS-CoV__AMQ49033__N
auggccagccccgccgcccccagagccguguucuucgccgacaacaacgacaucaccaacaccaaccugagcagaggcagaggcagaaaccccaagcccagagccgcccccaacaacaccgugagcugguacaccggccugacccagcacggcaaggugccccugaccuucccccccggccagggcgugccccugaacgccaacagcacccccgcccagaacgccggcuacuggagaagacaggacagaaagaucaacaccggcaacggcaucaagcagcuggcccccagaugguacuucuacuacaccggcaccggccccgaggccgcccugcccuucagagccgugaaggacggcaucgugugggugcacgaggacggcgccaccgacgcccccagcaccuucggcaccagaaaccccaacaacgacagcgccaucgugacccaguucgcccccggcaccaagcugcccaagaacuuccacaucgagggcaccggcggcaacagccagagcagcagcagagccagcagcgugagcagaaacagcagcagaagcagcagccagggcagcagaagcggcaacagcaccagaggcaccagccccggccccagcggcaucggcgccgugggcggcgaccugcuguaccuggaccugcugaacagacugcaggcccuggagagcggcaaggugaagcagagccagcccaaggugaucaccaagaaggacgccgccgccgccaagaacaagaugagacacaagagaaccagcaccaagagcuucaacauggugcaggccuucggccugagaggccccggcgaccugcagggcaacuucggcgaccugcaguucaacaagcugggcaccgaggaccccagauggccccagaucgccgagcuggcccccaccgccagcgccuucaugggcaugagccaguucaagcugacccaccagaacaacgacgaccacggcaaccccguguacuuccugagauacagcggcgccaucaagcuggaccccaagaaccccaacuacaacaaguggcuggagcugcuggagcagaacaucgacgccuacaagaccuuccccaagaaggagaagaagcagaaggcccccaaggaggagagcaccgaccagaugagcgagccccccaaggagcagagagugcagggcagcaucacccagagaaccagaaccagacccagcgugcagcccggccccaugaucgacgugaacaccgacuga

SEQ ID NO: 903 - RNA, 1242 nt, Artificial Sequence
  derived and/or modified CDS sequence (opt4) from MERS-CoV__AHL18098__N
auggccagcagcgccgcccccagagccgugagcuucgccgacaacaacgacaucaccaacaccaaccugagcagaggcagaggcagaaaccccaagcccagagccgcccccaacaacaccgugagcugguacaccggccugacccagcacggcaaggugccccugaccuucccccccggccagggcgugccccugaacgccaacagcacccccgcccagaacgccggcuacuggagaagacaggacagaaagaucaacaccggcaacggcaucaagcagcuggcccccagaugguacuucuacuacaccggcaccggccccgaggccgcccugcccuucagagccgugaaggacggcaucgugugggugcacgaggacggcgccaccgacgcccccagcaccuucggcaccagaaaccccaacaacgacagcgccaucgugacccaguucgcccccggcaccaagcugcccaagaacuuccacaucgagggcaccggcggcaacagccagagcagcagcagagccagcagcgugagcagaaacagcagcagaagcagcagccagggcagcagaagcggcaacagcaccagaggcaccagccccggccccagcggcaucggcgccgugggcggcgaccugcuguaccuggaccugcugaacagacugcaggcccuggagagcggcaaggugaagcagagccagcccaaggugaucaccaagaaggacgccgccgccgccaagaacaagaugagacacaagagaaccagcaccaagagcuucaacauggugcaggccuucggccugagaggccccggcgaccugcagggcaacuucggcgaccugcagcugaacaagcugggcaccgaggaccccagauggccccagaucgccgagcuggcccccaccgccagcgccuucaugggcaugagccaguucaagcugacccaccagaacaacgacgaccacggcaaccccguguacuuccugagauacagcggcgccaucaagcuggaccccaagaaccccaacuacaacaaguggcuggagcugcuggagcagaacaucgacgccuacaagaccuuccccaagaaggagaacaagcagaaggcccccaaggaggagagcaccgaccagaugagcgagccccccaaggagcagagagugcagggcagcaucacccagagaaccagaaccagacccagcgugcagcccggccccaugaucgacgugaacaccgacuga

SEQ ID NO: 904 - RNA, 1242 nt, Artificial Sequence
  derived and/or modified CDS sequence (opt4) from MERS-CoV__AHX00738__N
auggccgcccccgccgcccccagagccgugagcuucgccgacaacaacgacaucaccaacaccaacaugagcagaggcagaggcagaaaccccaagcccagagccgcccccaacaacaccgugagcugguacaccggccugacccagcacggcaaggugccccugaccuucccccccggccagggcgugccccugaacgccaacagcacccccgcccagaacgccggcuacuggagaagacaggacagaaagaucaacaccggcaacggcaucaagcagcuggcccccagaugguacuucuacuacaccggcaccggccccgaggccgcccugcccuucagagccgugaaggacggcaucgugugggugcacgaggacggcgccaccgacgcccccagcaccuucggcaccagaaaccccaacaacgacagcgccaucgugacccaguucgcccccggcaccaagcugcccaagaacuuccacaucgagggcaccggcggcaacagccagagcagcagcagagccagcagcgugagcagaaacagcagcagaagcagcagccagggcagcagaagcggcaacagcaccagaggcaccagccccggccccagcggcaucggcgccgugggcggcgaccugcuguaccuggaccugcugaacagacugcaggcccuggagagcggcaaggugaagcagagccagcccaaggugaucaccaagaaggacgccgccgccgccaagaacaagaugagacacaagagaaccagcaccaagagcuucaacauggugcaggccuucggccugagaggccccggcgaccugcagggcaacuucggcgaccugcagcugaacaagcugggcaccgaggaccccagauggccccagaucgccgagcuggcccccaccgccagcgccuucaugggcaugagccaguucaagcugacccaccagaacaacgacgaccacggcaaccccguguacuuccugagauacagcggcgccaucaagcuggaccccaagaaccccaacuacaacaaguggcuggagcugcuggagcagaacaucgacgccuacaagaccuuccccaagaaggagaagaagcagaaggcccccaaggaggagagcaccgaccagaugagcgagccccccaaggagcagagagugcagggcagcaucacccagagaaccagaaccagacccagcgugcagcccggccccaugaucgacgugaacaccgacuga

SEQ ID NO: 905 - RNA, 1242 nt, Artificial Sequence
  derived and/or modified CDS sequence (opt4) from MERS-CoV__AHY22561__N
auggccagccccgccgcccccagagccgugagcuucgccgacaacaacgacaucaccaacaccaaccugagcagaggcagaggcagaaaccccaagcccagagccgcccccaacaacaccgugagcugguacaccggccugacccagcacggcaaggugccccugaccuucccccccggccagggcgugccccugaacgccaacagcacccccgcccagaacgccggcuacuggagaagacaggacagaaagaucaacaccggcaacggcaucaagcagcuggcccccagaugguacuucuacuacaccggcaccggccccgaggccgcccugcccuucagagccgugaaggacggcaucgugugggugcacgaggacggcgccaccgacgcccccagcaccuucggcaccagaaaccccaacaacgacagcgccaucgugacccaguucgcccccggcaccaagcugcccaagaacuuccacaucgagggcaccggcggcaacagccagagcagcagcagagccagcagcgugagcagaaacagcagcagaagcagcagccagggcagcagaagcggcaacagcaccagaggcaccagccccggccccagcggcaucggcgccgugggcggcgaccugcuguaccuggaccugcugaacagacugcaggcccuggagagcggcaaggugaagcagagccagcccaaggugaucaccaagaaggacgccgccgccgccaagaacaagaugagacacaagagaaccagcaccaagagcuucaacauggugcaggccuucggccugagaggccccggcgaccugcagggcaacuucggcgaccugcagcugaacaagcugggcaccgaggaccccagauggccccagaucgccgagcuggcccccaccgccagcgccuucaugggcaugagccaguucaagcugacccaccagaacaacgacgaccacggcaaccccguguacuuccugagauacagcggcgccaucaagcuggaccccaagaaccccaacuacaacaaguggcuggagcugcuggagcagaacaucgacgccuacaagaccuuccccaagaaggagaacaagcagaaggcccccaaggaggagagcaccgaccagaugagcgagccccccaaggagcagagagugcagggcagcaucacccagagaaccagaaccagacccagcgugcagcccggccccaugaucgacgugaacaccgacuga

SEQ ID NO: 906 - RNA, 1242 nt, Artificial Sequence
  derived and/or modified CDS sequence (opt4) from MERS-CoV__AHY22571__N
auggccgcccccgccgcccccagagccgugagcuucgccgacaacaacgacaucaccaacaccaaccugagcagaggcagaggcagaaaccccaagcccagagccgcccccaacaacaccgugagcugguacaccggccugacccagcacggcaaggugccccugaccuucccccccggccagggcgugccccugaacgccaacagcacccccgcccagaacgccggcuacuggagaagacaggacagaaagaucaacaccggcaacggcaucaagcagcuggcccccagaugguacuucuacuacaccggcaccggccccgaggccgcccugcccuucagagccgugaaggacggcaucgugugggugcacgaggacggcgccaccgacgcccccagcaccuucggcaccagaaaccccaacaacgacagcgccaucgugacccaguucgcccccggcaccaagcugcccaagaacuuccacaucgagggcaccggcggcaacagccagagcagcagcagagccagcagcgugagcagaaacagcagcagaagcagcagccagggcagcagaagcagaaacagcaccagaggcaccagccccggccccagcggcaucggcgccgugggcggcgaccugcuguaccuggaccugcugaacagacugcaggcccuggagagcggcaaggugaagcagagccagcccaaggugaucaccaagaaggacgccgccgccgccaagaacaagaugagacacaagagaaccagcaccaagagcuucaacauggugcaggccuucggccugagaggccccggcgaccugcagggcaacuucggcgaccugcagcugaacaagcugggcaccgaggaccccagauggccccagaucgccgagcuggcccccaccgccagcgccuucaugggcaugagccaguucaagcugacccaccagaacaacgacgaccacggcaaccccguguacuuccugagauacagcggcgccaucaagcuggaccccaagaaccccaacuacaacaaguggcuggagcugcuggagcagaacaucgacgccuacaagaccuuccccaagaaggagaacaagcagaaggcccccaaggaggagagcaccgaccagaugagcgagccccccaaggagcagagagugcagggcagcaucacccagagaaccagaaccagacccagcgugcagcccggccccaugaucgacgugaacaccgacuga

SEQ ID NO: 907 - RNA, 1242 nt, Artificial Sequence
  derived and/or modified CDS sequence (opt4) from MERS-CoV__ALA49381__N
auggccagccccgccgcccccagagccgugagcuucgccgacaacaacgacaucaccaacaccaaccugagcagaggcagaggcagaaaccccaagcccagagccgcccccaacaacaccgugagcugguacaccggccugacccagcacggcaaggugccccugaccuucccccccggccagggcgugccccugaacgccaacagcacccccgcccagaacgccggcuacuggagaagacaggacagaaagaucaacaccggcaacggcaucaagcagcuggcccccagaugguacuucuacuacaccggcaccggccccgaggccgcccugcccuucagagccgugaaggacggcaucgugugggugcacgaggacggcgccaccgacgcccccagcaccuucggcaccagaaaccccaacaacgacagcgccaucgugacccaguucgcccccggcaccaagcugcccaagaacuuccacaucgagggcaccggcggcaacagccagagcagcagcagagccagcagcgugagcagaaacagcagcagaagcagcagccagggcagcagaagcggcaacagcaccagaggcagcagccccggccccagcggcaucggcgccgugggcggcgaccugcuguaccuggaccugcugaacagacugcaggcccuggagagcggcaaggugaagcagagccagcccaaggugaucaccaagaaggacgccgccgccgccaagaacaagaugagacacaagagaaccagcaccaagagcuucaacauggugcaggccuucggccugagaggccccggcgaccugcagggcaacuucggcgaccugcagcugaacaagcugggcaccgaggaccccagauggccccagaucgccgagcuggcccccaccgccagcgccuucaugggcaugagccaguucaagcugacccaccagaacaacgacgaccacggcaaccccguguacuuccugagauacagcggcgccaucaagcuggaccccaagaaccccaacuacaacaaguggcuggagcugcuggagcagaacaucgacgccuacaagaccuuccccaagaaggagaagaagcagaaggcccccaaggaggagagcaccgaccagaugagcgagccccccaaggagcagagagugcagggcagcaucacccagagaaccagaaccagacccagcgugcagcccggccccaugaucgacgugaacaccgacuga

SEQ ID NO: 908 - RNA, 1242 nt, Artificial Sequence
  derived and/or modified CDS sequence (opt4) from MERS-CoV__ALA49392__N
auggccagccccgccgcccccagagccgugagcuucgccgacaacaacgacaucaccaacaccaaccugagcagaggcagaggcagaaaccccaagcccagagccgcccccaacaacaccgugagcugguacaccggccugacccagcacggcaaggugccccugaccuucccccccggccagggcgugccccugaacgccaacagcacccccgcccagaacgccggcuacuggagaagacaggacagaaagaucaacaccggcaacggcaucaagcagcuggcccccagaugguacuucuacuacaccggcaccggccccgaggccgcccugcccuucagagccgugaaggacggcaucgugugggugcacgaggacggcgccaccgacgcccccagcaccuucggcaccagaaaccccaacaacgacagcgccaucgugacccaguucgcccccggcaccaagcugcccaagaacuuccacaucgagggcaccggcggcaacagccagagcagcagcagagccagcagcgugagcagaaacagcagcagaagcagcagccagggcagcagaagcggcaacagcaccagaggcagcagccccggccccagcggcaucggcgccgugggcggcgaccugcuguaccuggaccugcugaacagacugcaggcccuggagagcggcaaggugaagcagagccagcccaaggugaucaccaagaaggacgccgccgccgccaagaacaagaugagacacaagagaaccagcaccaagagcuucaacauggugcaggccuucggccugagaggccccggcgaccugcagggcaacuucggcgaccugcagcugaacaagcugggcaccgaggaccccagauggccccagaucgccgagcuggcccccaccgccagcgccuucaugggcaugagccaguucaagcugacccaccagaacaacgacgaccacggcaaccccguguacuuccugagauacagcggcgccaucaagcuggaccccaagaaccccaacuacaacaaguggcuggagcugcuggagcagaacaucgacgccuacaagaccuuccccaagaaggagaagaagcagaaggcccccaaggaggagagcaccgaccagaugagcgagccccccaaggagcagagagugagaggcagcaucacccagagaaccagaaccagacccagcgugcagcccggccccaugaucgacgugaacaccgacuga

SEQ ID NO: 909 - RNA, 1242 nt, Artificial Sequence
  derived and/or modified CDS sequence (opt4) from MERS-CoV__ALA49601__N
auggccagccccgccgcccccagagccgugagcuucgccgacaacaacgacaucaccaacaccaaccugagcagaggcagaggcagaaaccccaagcccagagccgcccccaacaacaccgugagcugguacaccggccugacccagcacggcaaggugccccugaccuucccccccggccagggcgugccccugaacgccaacagcacccccgcccagaacgccggcuacuggagaagacaggacagaaagaucaacaccggcaacggcaucaagcagcuggcccccagaugguacuucuacuacaccggcaccggccccgaggccgcccugcccuucagagccgugaaggacggcaucgugugggugcacgaggacggcgccaccgacgcccccagcaccuucggcaccagaaaccccaacaacgacagcgccaucgugacccaguucgcccccggcaccaagcugcccaagaacuuccacaucgagggcaccggcggcaacagccagagcagcagcagagccagcagcgugagcagaaacagcagcagaagcagcagccagggcagcagaagcggcaacagcaccagaggcaccagccccggccugagcggcaucggcgccgugggcggcgaccugcuguaccuggaccugcugaacagacugcaggcccuggagagcggcaaggugaagcagagccagcccaaggugaucaccaagaaggacgccgccgccgccaagaacaagaugagacacaagagaaccagcaccaagagcuucaacauggugcaggccuucggccugagaggccccggcgaccugcagggcaacuucggcgaccugcagcugaacaagcugggcaccgaggaccccagauggccccagaucgccgagcuggcccccaccgccagcgccuucaugggcaugagccaguucaagcugacccaccagaacaacgacgaccacggcaaccccguguacuuccugagauacagcggcgccaucaagcuggaccccaagaaccccaacuacaacaaguggcuggagcugcuggagcagaacaucgacgccuacaagaccuuccccaagaaggagaagaagcagaaggcccccaaggaggagagcaccgaccagaugagcgagccccccaaggagcagagagugcagggcagcaucacccagagaaccagaaccagacccagcgugcagcccggccccaugaucgacgugaacaccgacuga

SEQ ID NO: 910 - RNA, 1242 nt, Artificial Sequence
  derived and/or modified CDS sequence (opt4) from MERS-CoV__ALA49843__N
auggccagccccgccgcccccagagccgugagcuucgccgacaacaacgacaucaccaacaccaaccugagcagaggcagaggcagaaaccccaagcccagagccgcccccaacaacaccgugagcugguacaccggccugacccagcacggcaaggugccccugaccuucccccccggccagggcgugccccugaacgccaacagcacccccgcccagaacgccggcuacuggagaagacaggacagaaagaucaacaccggcaacggcaucaagcagcuggcccccagaugguacuucuacuacaccggcaccggccccgaggccgcccugcccuucagagccgugaaggacggcaucgugugggugcacgaggacggcgccaccgacgcccccagcaccuucggcaccagaaaccccaacaacgacagcgccaucgugacccaguucgcccccggcaccaagcugcccaagaacuuccacaucgagggcaccggcggcaacagccagagcagcagcagagccagcagcgugagcagaaacagcagcagaagcagcagccagggcagcagaagcggcaacagcaccagaugcaccagccccggccccagcggcaucggcgccgugggcggcgaccugcuguaccuggaccugcugaacagacugcaggcccuggagagcggcaaggugaagcagagccagcccaaggugaucaccaagaaggacgccgccgccgccaagaacaagaugagacacaagagaaccagcaccaagagcuucaacauggugcaggccuucggccugagaggccccggcgaccugcagggcaacuucggcgaccugcagcugaacaagcugggcaccgaggaccccagauggccccagaucgccgagcuggcccccaccgccagcgccuucaugggcaugagccaguucaagcugacccaccagaacaacgacgaccacggcaaccccguguacuuccugagauacagcggcgccaucaagcuggaccccaagaaccccaacuacaacaaguggcuggagcugcuggagcagaacaucgacgccuacaagaccuuccccaagaaggagaagaagcagaaggcccccaaggaggagagcaccgaccagaugagcgagccccccaaggagcagagagugcagggcagcaucacccagagaaccagaaccagacccagcgugcagcccggccccaugaucgacgugaacaccgacuga

SEQ ID NO: 911 - RNA, 1242 nt, Artificial Sequence
  derived and/or modified CDS sequence (opt4) from MERS-CoV__ALA49865__N
auggccagccccgccgcccccagagccgugagcuucgccgacaacaacgacaucaccaacaccaaccugagcagaggcagaggcagaaaccccaagcccagagccgcccccaacaacaccgugagcugguacaccggccugacccagcacggcaaggugccccugaccuucccccccggccagggcgugccccugaacgccaacagcacccccgcccagaacgccggcuacuggagaagacaggacagaaagaucaacaccggcaacggcaucaagcagcuggcccccagaugguacuucuacuacaucggcaccggccccgaggccgcccugcccuucagagccgugaaggacggcaucgugugggugcacgaggacggcgccaccgacgcccccagcaccuucggcaccagaaaccccaacaacgacagcgccaucgugacccaguucgcccccggcaccaagcugcccaagaacuuccacaucgagggcaccggcggcaacagccagagcagcagcagagccagcagcgugagcagaaacagcagcagaagcagcagccagggcagcagaagcggcaacagcaccagaggcaccagccccggccccagcggcaucggcgccgugggcggcgaccugcuguaccuggaccugcugaacagacugcaggcccuggagagcggcaaggugaagcagagccagcccaaggugaucaccaagaaggacgccgccgccgccaagaacaagaugagacacaagagaaccagcaccaagagcuucaacauggugcaggccuucggccugagaggccccggcgaccugcagggcaacuucggcgaccugcagcugaacaagcugggcaccgaggaccccagauggccccagaucgccgagcuggcccccaccgccagcgccuucaugggcaugagccaguucaagcugacccaccagaacaacgacgaccacggcaaccccguguacuuccugagauacagcggcgccaucaagcuggaccccaagaaccccaacuacaacaaguggcuggagcugcuggagcagaacaucgacgccuacaagaccuuccccaagaaggagaagaagcagaaggcccccaaggaggagagcaccgaccagaugagcgagccccccaaggagcagagagugcagggcagcaucacccagagaaccagaaccagacccagcgugcagcccggccccaugaucgacgugaacaccgacuga

SEQ ID NO: 912 - RNA, 1242 nt, Artificial Sequence
  derived and/or modified CDS sequence (opt4) from MERS-CoV__ALA49909__N
auggccagccccgccgcccccagagccgugagcuucgccgacaacaacgacaucaccaacaccaaccugagcagaggcagaggcagaaaccccaagcccagagccgcccccaacaacaccgugagcugguacaccggccugacccagcacggcaaggugccccugaccuucccccccggccagggcgugccccugaacgccaacagcacccccgcccagaacgccggcuacuggagaagacaggacagaaagaucaacaccggcaacggcaucaagcagcuggcccccagaugguacuucuacuacaccggcaccggccccgaggccgcccugcccuucagagccgugaaggacggcaucgugugggugcacgagcacggcgccaccgacgcccccagcaccuucggcaccagaaaccccaacaacgacagcgccaucgugacccaguucgcccccggcaccaagcugcccaagaacuuccacaucgagggcaccggcggcaacagccagagcagcagcagagccagcagcgugagcagaaacagcagcagaagcagcagccagggcagcagaagcggcaacagcaccagaugcaccagccccggccccagcggcaucggcgccgugggcggcgaccugcuguaccuggaccugcugaacagacugcaggcccuggagagcggcaaggugaagcagagccagcccaaggugaucaccaagaaggacgccgccgccgccaagaacaagaugagacacaagagaaccagcaccaagagcuucaacauggugcaggccuucggccugagaggccccggcgaccugcagggcaacuucggcgaccugcagcugaacaagcugggcaccgaggaccccagauggccccagaucgccgagcuggcccccaccgccagcgccuucaugggcaugagccaguucaagcugacccaccagaacaacgacgaccacggcaaccccguguacuuccugagauacagcggcgccaucaagcuggaccccaagaaccccaacuacaacaaguggcuggagcugcuggagcagaacaucgacgccuacaagaccuuccccaagaaggagaagaagcagaaggcccccaaggaggagagcaccgaccagaugagcgagccccccaaggagcagagagugcagggcagcaucacccagagaaccagaaccagacccagcgugcagcccggccccaugaucgacgugaacaccgacuga

SEQ ID NO: 913 - RNA, 4062 nt, Artificial Sequence
  derived and/or modified CDS sequence (opt5) from MERS-CoV__AFS88936__S
augauccacagcguguuccugcucauguuucugcuuacccccacagaguccuacgucgacguuggcccugauucugucaagagcgccugcauugaaguggacauccagcagacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaagacccaugccacgcuuuuuggcagcguggcuugugaacacauuuccagcacaaugucucaguacucccggagcaccagaucuaugcucaaacgccgggacuccacauaugggccccugcagaccccuguuggcugcgugcugggacucgucaauagcucucuguucguggaggauuguaaacuuccccugggccaaucccucugcgcccugccggacaccccuagcacacugacgcccagauccguucgcagcgugcccggggaaaugcggcuugcgucuaucgccuuuaaccacccuauucaggucgaucagcucaauagcuccuacuucaagcugucuaucccgaccaacuuuagcuucggagugacacaagaguauauccagaccacaauucagaaggugaccgucgacuguaaacaguacguuugcaauggcuuccaaaagugcgaacagcugcucagagaguaugggcaguuuuguuccaagaucaaccaggcucugcauggagccaaucuucgccaagaugacucugugcggaaccuguucgcuagcgugaaauccucucagagcucccccauuaucccuggcuuugggggcgacuucaaucucacgcugcuggagcccgucagcauuucuacaggauccagaagcgcccgcucugcgaucgaagaucuucucuuugacaaggugaccaucgccgauccuggcuacaugcagggguacgacgauugcaugcagcaaggacccgcuuccgcccgggaccugauuugugcucaguauguugccggcuacaaagugcugccuccccucauggaugucaacauggaggccgcuuauaccagcucccugcuugggucuaucgcgggagugggcuggacagccgggcugagcuccuucgcugccauuccguuugcccagagcaucuucuacagacucaauggcguuggaauuacccaacaggugcugucugaaaaccagaagcugaucgcuaauaaauuuaaccaggcccuuggcgcgaugcaaacaggguucacgaccacaaaugaggcuuuucagaagguccaggacgccgugaacaacaaugcccaggcucucuccaagcuggccagcgaacugucuaacaccuucggagcgaucagcgcuuccauuggcgauaucauucaacggcucgacguucuggagcaggaugcccagaucgaccgccuuauuaaugggagacugacaacccucaacgccuucguggcucagcaacugguccggucugagagcgccgcucuguccgcccagcuugcgaaagauaaggugaaugaaugcgugaaagcccagucuaagagaagcggauuuuguggccagggcacgcacaucgucuccuucguugugaacgcuccuaaugggcuguauuuuaugcaugugggauacuaucccagcaaccacaucgaggucgugucugccuacggccucugcgacgcugccaauccuaccaacuguauugcccccguuaauggguacuucaucaaaacaaacaauacccgcauuguggacgaaugguccuauacaggaagcuccuuuuacgcuccggagccuaucaccucucugaacacaaaguaugucgcgccccaagugaccuaccagaauauuagcacgaaccucccuccuccccugcuuggcaacuccacagggaucgauuuccaggacgagcuggaugaauuuuucaagaauguuucuaccagcauucccaacuuuggaucccucacccaaaucaauacaacccugcuggaccuuacguaugagaugcugagccuccaacagguggucaaagcccugaacgaaucuuacaucgaucucaaggagcugggcaauuauacauacuacaacaaauggccgugguauauuuggcuuggcuucaucgcugggcugguggcccucgcccugugcgucuuuuucauucuguguugcaccggauguggcacaaauugcauggggaaacuuaagugcaaccgguguugcgacagauacgaagaguaugaucuggagccccauaaggugcacguucacuga

SEQ ID NO: 914 - RNA, 4062 nt, Artificial Sequence
  derived and/or modified CDS sequence (opt5) from MERS-CoV__AFY13307__S
augauccacagcguguuccugcucauguuucugcuuacccccacagaguccuacgucgacguuggcccugauucugugaaguccgccugcauugaaguggacauccagcaaacguucuuugauaaaaccuggccgagacccauugacgucuccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucugagcggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagauuucuuagcgaugaccggaccgaagucccucagcuggugaacgccaaucaauauucccccuguguuagcauugugccgucuacagucugggaggacggggauuacuaccgcaaacagcucuccccucuggaaggaggcggguggcugguggcuagcggauccaccguugccaugacagagcagcuccagaugggcuucgggaucaccgugcaauauggcacggacaccaacucugucugccccaagcuggaauuugcgaaugauacaaaaauugcuagccagcuuggaaacuguguggaguacucccuguauggcgugucugggagaggaguuuuccagaauugcaccgccgucggcgugcggcagcaaagauuuguguacgacgccuaucagaaccucgucggguacuauagcgaugacggaaacuacuacugucugcgcgcuugcguguccguuccugugucugucaucuaugauaaggagacaaagacccaugccacgcuguucggcagcguggcuugugaacacauuuccagcacaaugucucaguacucccggagcaccagaucuaugcuuaaacgccgggacuccacauaugggccccuccagaccccuguuggcugcgugcugggacuggucaauagcucucucuuuguggaggauuguaagcugccccuuggccaaucccugugcgcccucccggacaccccuagcacacugacgcccagauccguucgcagcgugcccggggaaaugcggcuggcgucuaucgccuucaaccacccuauucaggucgaucagcuuaauagcuccuacuuuaaacucucuaucccgaccaacuucagcuucggagugacacaagaguauauccagaccacaauucagaaggugaccgucgacuguaaacaguacguuugcaauggcuuucaaaagugcgaacagcugcugagagaguaugggcaguucuguuccaagaucaaccaggcucuccauggagccaaucugcgccaagaugacucugugcggaaccuuuuugcuagcgugaaauccucucagagcucccccauuaucccuggcuucgggggcgacuuuaaucugacgcuccuggagcccgucagcauuucuacaggauccagaagcgcccgcucugcgaucgaagaucugcuuuucgacaaggugaccaucgccgauccuggcuacaugcagggguacgacgauugcaugcagcaaggacccgcuuccgcccgggaccucauuugugcucaguauguugccggcuacaaagugcugccuccccugauggaugucaacauggaggccgcuuauaccagcucccuccuggggucuaucgcgggagugggcuggacagccgggcuuagcuccuuugcugccauuccguucgcccagagcaucuuuuacagacugaauggcguuggaauuacccaacaggugcucucugaaaaccagaagcugaucgcuaauaaauucaaccaggcccugggcgcgaugcaaacaggguuuacgaccacaaaugaggcuuuccacaagguccaggacgccgugaacaacaaugcccaggcucuuuccaagcucgccagcgaacugucuaacaccuucggagcgaucagcgcuuccauuggcgauaucauucagcggcuggacguucucgagcaagaugcccagaucgaccgccugauuaaugggagacuuacaacccugaacgccuuuguggcucagcagcucguccggucugagagcgccgcucuguccgcccaacuggcgaaagauaaggugaaugaaugcgugaaagcccagucuaagagaagcggauucuguggccagggcacgcauaucgucuccuuuguugugaacgcuccuaaugggcuuuauuucaugcacgugggauacuaucccagcaaccauaucgaggucgugucugccuacggccugugcgacgcugccaauccuaccaacuguauugcccccguuaauggguacuuuaucaaaacaaacaauacccgcauuguggacgaaugguccuauacaggaagcuccuucuacgcuccggagccuaucaccucucucaacacaaaguaugucgcgccccaggugaccuaccaaaauauuagcacgaaccugccuccuccccuccugggcaacuccacagggaucgauuuucaggacgagcuugaugaguucuuuaagaauguuucuaccagcauucccaacuucggaucccugacccagaucaauacaacccuccuggaccugacguaugaaaugcuuagccugcaacagguggucaaagcccucaacgaaucuuacaucgaucugaaggagcucggcaauuauacauacuacaacaaauggccgugguauauuuggcugggcuuuaucgcugggcuuguggcccuggcccucugcgucuucuuuauucuguguugcaccggauguggcacaaauugcauggggaagcugaaaugcaaccgguguugcgacagauacgaagaguaugaucuugagccccacaaggugcacguucauuga

SEQ ID NO: 915 - RNA, 4062 nt, Artificial Sequence
  derived and/or modified CDS sequence (opt5) from MERS-CoV__AGH58717__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccguuacaaccccucaaaaacucuuuguggcuaauuauucccaggacgucaagcaguucgccaacggguuugugguucgcauuggagccgcugccaauucuacgggcaccgugaucauuagccccuccacaagcgcuaccaucagaaaaauuuacccugccuucaugcuggggucuuccgucgggaacuuuagcgauggaaagaugggccgguucuuuaaucauacacuugugcugcucccggacggguguggaacccugcugcgcgcguucuacugcauccucgagcccagaucuggcaacuauuguccugccggcaauuccuacacgagcuuugcuacauaucacacccccgccacagauugcucugacggaaacuacaaucggaacgcuucccugaauagcuucaaggaauauuucaaccuucgcaauuguaccuuuauguacaccuauaacauuacagaggaugaaauccuggagugguucggcaucacgcagaccgcccaaggcgugcaucucuuuuccucuagauacgucgaccuguacgggggaaauauguuccaguuugcgacacuuccuguuuaugacaccauuaaauacuauagcaucauuccccacuccauccugagcauucagucugaucggaaggccugggcugccuucuacguguauaaacuccagccgcugacauuucugcucgacuucuccguggauggcuacauccgcagagcuaucgacugcggguuuaacgaucugagccaacuucacuguucuuaugagagcuucgacgucgaauccggaguguacucuguuagcuccuuugaggccaagccuagcggcucuguggucgaacaggccgaggggguggagugcgauuucagcccccugcucuccggaaccccuccccagguuuacaacuuuaaacggcugguguucacgaauuguaacuauaaucuuacaaagcugcucucucuguucuccgucaacgacuuuaccugcagccaaauuucccccgcugcgaucgccucuaauuguuacagcucccugauucucgauuauuucucuuacccucugagcaugaaguccgaccuuagcgugucuuccgcuggcccgaucagccaguuuaacuauaaacagucuuucuccaauccuaccugccugauucucgccacagucccccauaaccugaccacaaucacgaagccccuuaaauacagcuauaucaauaagugcucucgccugcucagcgaugacagaaccgaagugccucagcugguuaacgccaaucaauacucccccugugugagcauugucccgucuacagugugggaggacggcgauuacuaucggaaacagcuguccccucucgaagggggaggcuggcugguugcuagcggguccaccguggccaugacagagcagcuucagaugggauuuggcaucaccguccaauacgggacggacaccaacucugugugccccaagcuggaguucgcgaaugauacaaaaauugcuagccagcucggcaacuguguggaauauucccuguacggaguuucuggccgcggggucuuucagaauugcaccgccgugggagugagacagcaacgguucgucuaugacgccuaccagaaccuggugggcuauuacagcgaugacgggaacuacuauugucuuagagcuugcguuuccgugccugucucugugaucuacgauaaggagacaaagacccacgccacgcucuuuggaagcguugcuugugaacauauuuccagcacaaugucucaguauucccgcagcacccggucuaugcugaaaagacgcgacuccacauacggcccccugcagaccccuguggggugcguccucggccuggugaauagcucucuuuucguugaggauuguaagcugccccucggacaaucccugugcgcccugccggacaccccuagcacacuuacgccccgguccgugagaagcguccccggcgaaaugcgccucgcgucuaucgccuuuaaccacccuauucagguggaucagcugaauagcuccuauuucaaacugucuaucccgaccaacuuuagcuucggggugacacaagaguacauccagaccacaauucagaaggucaccguugacuguaaacaguaugugugcaauggauuccaaaagugcgaacagcuccugcgggaguacggccaguuuuguuccaagaucaaccaggcccuucacggggcuaaucugagacaagaugacucugugcgcaaccucuucgcuagcgucaaauccucucagagcucccccauuaucccuggauuuggcggggacuucaaucugacgcugcuugagcccgugagcauuucuacaggcucccggagcgccagaucugcgaucgaagaucuccuguuugacaagguuaccaucgccgauccuggauacaugcagggcuaugacgauugcaugcagcaagggcccgcuuccgcccgcgaccugauuugugcucaguacguggccggauauaaaguccucccuccccugauggaugugaacauggaggccgcuuacaccagcucccuucugggcucuaucgcggggguuggauggacagccggccucagcuccuucgcugccauuccguuugcccagagcaucuucuaucggcugaauggggugggcauuacccaacagguccugucugaaaaccagaaacuuaucgcuaauaaguuuaaccaggcccucggagcgaugcaaacaggcuucacgaccacaaaugaggcuuuucagaaggugcaggacgccguuaacaacaaugcccaggcucuguccaagcuggccagcgaacucucuaacaccuucggggcgaucagcgcuuccauuggagauaucauucaaagacuggacgugcuugagcaggaugcccagaucgaccggcugauuaauggccgccucacaacccugaacgccuucgucgcucagcaacuggugagaucugagagcgccgcucuuuccgcccagcuggcgaaagauaaggugaaugaaugcgucaaagcccagucuaagcggagcggguuuuguggacagggcacgcauaucguuuccuucguggugaacgcuccuaauggccucuacuuuaugcacgucggguauuaccccagcaaccauaucgaggugguuucugccuacggacugugcgacuccgcuaauccuaccaacuguauugcccccgugaauggcuauuucaucaaaacaaacaauaccagaauugucgacgaauggagcuacacaggguccucuuuuuaugccccggagccuaucaccagccucaacacaaaguacguggcuccccaaguuaccuaucagaauauuuccacgaaccugccuccuccccuucugggaaacucuacaggcaucgauuuccaggacgagcucgaugaauuuuucaagaaugugagcaccuccauucccaacuuugggagccugacccaaaucaauacaacccugcuugaccugacguacgagaugcucucucugcagcaggucgugaaagcgcucaacgaauccuauaucgaucugaaggagcuuggaaauuacacauacuauaacaaauggccgugguacauuuggcugggcuucaucgccggccucgucgcucuggcccugugcguguuuuucauucuuuguugcaccggguguggaacaaauugcaugggcaagcugaaaugcaaccgcuguugcgaccgguaugaagaguacgaucucgagccccacaagguucaugugcacuga

SEQ ID NO: 916 - RNA, 4062 nt, Artificial Sequence
  derived and/or modified CDS sequence (opt5) from MERS-CoV__AGN52936__S
augauccacagcguguuccugcucauguuucugcuuacccccacagaguccuacgucgacguuggcccugauucuauuaagagcgccugcaucgaaguggacauucagcaaacguucuuugauaaaaccuggccgagacccaucgacguguccaaggcugaugggauuaucuauccucagggacggacauacucuaacaucaccauuacauaucagggccuguuccccuaccagggggaccauggagauauguaugucuacagcgccggccacgcgaccgggacaaccccucaaaaacucuuuguggcuaauuauucccaggacguuaagcaguucgccaacggauuugugguccgcaucggcgccgcugccaauucuacgggcaccgugauuaucagccccuccacaagcgcuaccauuagaaaaaucuacccugccuucaugcuggggucuuccguuggaaacuuuagcgauggcaagauggggcgguucuuuaaucauacacuugugcugcucccggacggauguggcacccugcugcgcgcguucuacugcauucucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacaucacagaggaugaaauccuggagugguucggcauuacgcagaccgcccaagggguccaccucuuuuccucuagauauguggaccuguacggaggcaauauguuccaguuugcgacacuuccuguguacgacaccaucaaauauuacagcauuaucccccacuccauucggagcauccagucugaucgcaaggccugggcugccuucuaugucuacaaacugcagccgcucacauuucugcuggacuucuccguugauggguauaucagacgggcuauugacugcggauuuaacgaucucagccaacugcauuguucuuacgagagcuucgacguggaauccggcguguauucugucagcuccuuugaggccaagccuagcgggucugugguugaacaggccgagggaguggagugcgauuucagcccccuucuguccggcaccccuccccaggucuacaacuuuaaacgccucguguucacgaauuguaacuacaaucugacaaaacuucugucucucuucuccguuaacgacuuuaccugcagccaaaucucccccgcugcgauugccucuaauuguuauagcucccugauccuggauuacuucucuuauccucucagcaugaaguccgaccugagcgugucuuccgcuggcccgauuagccaguuuaacuacaagcagucuuucuccaauccuaccugccuuauccuggccacagucccccacaaccucaccacaaucacgaagccccugaaauauagcuacauuaauaagugcucuagacuucugagcgaugaccggaccgaagugccucagcucgucaacgccaaucaauauucccccugugugagcaucguuccgucuacagugugggaggacggggauuacuaccgcaaacagcuguccccucuggaaggaggcggguggcucgucgcuagcggauccaccguggccaugacagagcagcugcagaugggcuuugggauuaccguucaauauggcacggacaccaacucugugugccccaaacuugaguucgcgaaugauacaaagaucgcuagccagcugggaaacugugucgaauacucccucuauggcgugucugggagaggaguguuucagaauugcaccgccguuggcguccggcagcaaagauucguguacgacgccuaucagaaccuggugggguacuauagcgaugacggaaacuacuacugucugcgcgcuugcgucuccgugccuguuucugugauuuaugauaaggagacaaagacccaugccacgcuuuuuggcagcgucgcuugugaacacaucuccagcacaaugucucaguacucccggagcaccagaucuaugcucaaacgccgggacuccacauaugggccccugcagaccccugugggcugcguucugggacucgugaauagcucucuguucgucgaggauuguaaacuuccccugggccaaucccucugcgcccugccggacaccccuagcacacugacgcccagauccgugcgcagcguucccggggaaaugcggcuugcgucuauugccuuuaaccacccuauccagguggaucagcucaauagcuccuacuucaagcugucuaucccgaccaacuuuagcuucggagucacacaagaguauauucagaccacaauccagaaggugaccguggacuguaaacaguacgucugcaauggcuuccaaaagugcgaacagcugcucagagaguaugggcaguuuuguuccaagauuaaccaggcucugcauggagccaaucuucgccaagaugacucuguucggaaccuguucgcuagcgugaaauccucucagagcucccccaucauuccuggcuuugggggcgacuucaaucucacgcugcuggagcccgugagcaucucuacaggauccagaagcgcccgcucugcgaucgaagaucuucucuuugacaaggucaccauugccgauccuggcuacaugcagggguacgacgauugcaugcagcaaggacccgcuuccgcccgggaccugaucugugcucaguauguggccggcuacaaaguucugccuccccucauggaugugaacauggaggccgcuuauaccagcucccugcuugggucuauugcgggagucggcuggacagccgggcugagcuccuucgcugccaucccguuugcccagagcauuuucuacagacucaauggcgugggaaucacccaacagguucugucugaaaaccagaagcugaucgcuaauaaauuuaaccaggcccuuggcgcgaugcaaacaggguucacgaccacaaaugaggcuuuucacaaggugcaggacgccgucaacaacaaugcccaggcucucuccaagcuggccagcgaacugucuaacaccuucggagcgauuagcgcuuccaucggcgauauuauccagcggcucgacgugcuggagcaagaugcccagauugaccgccuuaucaaugggagacugacaacccucaacgccuucguugcucagcagcuggugcggucugagagcgccgcucuguccgcccaacuugcgaaagauaaggucaaugaaugcgugaaagcccagucuaagagaagcggauuuuguggccagggcacgcauaucguguccuucgucguuaacgcuccuaaugggcuguauuuuaugcacgugggauacuaucccagcaaccauauugagguggucucugccuacggccucugcgacgcugccaauccuaccaacuguaucgcccccgugaauggguacuucauuaaaacaaacaauacccgcaucguugacgaaugguccuauacaggaagcuccuuuuacgcuccggagccuauuaccucucugaacacaaaguauguggcgccccaggucaccuaccaaaauaucagcacgaaccucccuccuccccugcuuggcaacuccacagggauugauuuccaggacgagcuggaugaauuuuucaagaaugugucuaccagcauccccaacuuuggaucccucacccagaucaauacaacccugcuggaccuuacguaugagaugcugagccuccaacagguugugaaagcccugaacgaaucuuacauugaucucaaggagcugggcaauuauacauacuacaacaaauggccgugguauaucuggcuuggcuucauugcugggcuggucgcccucgcccugugcguguuuuucauccuguguugcaccggauguggcacaaauugcauggggaaacuuaagugcaaccgguguugcgacagauacgaagaguaugaucuggagccccacaagguccacgugcauuga

SEQ ID NO: 917 - RNA, 4062 nt, Artificial Sequence
  derived and/or modified CDS sequence (opt5) from MERS-CoV__AGN70951__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaagacccaugccacgcuuuuuggcagcguggcuugugaacacauuuccagcacaaugucucaguacucccggagcaccagaucuaugcucaaacgccgggacuccacauaugggccccugcagaccccuguuggcugcgugcugggacucgucaauagcucucuguucguggaggauuguaaacuuccccugggccaaucccucugcgcccugccggacaccccuagcacacugacgcccagauccguucgcagcgugcccggggaaaugcggcuugcgucuaucgccuuuaaccacccuauucaggucgaucagcucaauagcuccuacuucaagcugucuaucccgaccaacuuuagcuucggagugacacaagaguauauccagaccacaauucagaaggugaccgucgacuguaaacaguacguuugcaauggcuuccaaaagugcgaacagcugcucagagaguaugggcaguuuuguuccaagaucaaccaggcucugcauggagccaaucuucgccaagaugacucugugcggaaccuguucgcuagcgugaaauccucucagagcucccccauuaucccuggcuuugggggcgacuucaaucucacgcugcuggagcccgucagcauuucuacaggauccagaagcgcccgcucugcgaucgaagaucuucucuuugacaaggugaccaucgccgauccuggcuacaugcagggguacgacgauugcaugcagcaaggacccgcuuccgcccgggaccugauuugugcucaguauguugccggcuacaaagugcugccuccccucauggaugucaacauggaggccgcuuauaccagcucccugcuugggucuaucgcgggagugggcuggacagccgggcugagcuccuucgcugccauuccguuugcccagagcaucuucuacagacucaauggcguuggaauuacccaacaggugcugucugaaaaccagaagcugaucgcuaauaaauuuaaccaggcccuuggcgcgaugcaaacaggguucacgaccacaaaugaggcuuuucggaagguccaggacgccgugaacaacaaugcccaggcucucuccaagcuggccagcgaacugucuaacaccuucggagcgaucagcgcuuccauuggcgauaucauucagcgccucgacguucuggagcaagaugcccagaucgacagacuuauuaaugggcggcugacaacccucaacgccuucguggcucagcagcuggucagaucugagagcgccgcucuguccgcccaacuugcgaaagauaaggugaaugaaugcgugaaagcccagucuaagcgcagcggauuuuguggccagggcacgcacaucgucuccuucguugugaacgcuccuaaugggcuguauuuuaugcaugugggauacuaucccagcaaccacaucgaggucgugucugccuacggccucugcgacgcugccaauccuaccaacuguauugcccccguuaauggguacuucaucaaaacaaacaauacccggauuguggacgaaugguccuauacaggaagcuccuuuuacgcuccggagccuaucaccucucugaacacaaaguaugucgcgccccaugugaccuaccagaauauuagcacgaaccucccuccuccccugcuuggcaacuccacagggaucgauuuccaagacgagcuggaugaauuuuucaagaauguuucuaccagcauucccaacuuuggaucccucacccagaucaauacaacccugcuggaccuuacguaugagaugcugagccuccagcaaguggucaaagcccugaacgaaucuuacaucgaucucaaggagcugggcaauuauacauacuacaacaaauggccgugguauauuuggcuuggcuucaucgcugggcugguggcccucgcccugugcgucuuuuucauucuguguugcaccggauguggcacaaauugcauggggaaacuuaagugcaacagauguugcgaccgcuacgaagaguaugaucuggagccccacaaggugcacguucauuga

SEQ ID NO: 918 - RNA, 4062 nt, Artificial Sequence
  derived and/or modified CDS sequence (opt5) from MERS-CoV__AGV08408__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcggggaucggaccgaagucccucagcucgugaacgccaaucaauauucccccuguguuagcauugugccgucuacagucugggaggacggagacuacuaccgcaaacagcuguccccucuggaaggcgggggauggcucguggcuagcggcuccaccguugccaugacagagcagcugcagaugggguuuggcaucaccgugcaauauggaacggauaccaacucugucugccccaaacuugaguucgcgaaugacacaaagauugcuagccagcugggcaacuguguggaauacucccucuauggggugucuggaagaggcguuuuucagaauugcaccgccgucggggugcggcagcaaagauucguguacgaugccuaucagaaccuggucggauacuauagcgacgauggcaacuacuacugucugcgcgcuugcguguccguuccugugucugucaucuaugacaaggagacaaagacccaugccacgcuuuuugggagcguggcuugugaacacauuuccagcacaaugucucaguacucccggagcaccagaucuaugcucaaacgccgggauuccacauauggcccccugcagaccccuguuggaugcgugcugggccucgucaauagcucucuguucguggaggacuguaaacuuccccuggggcaaucccucugcgcccugccggauaccccuagcacacugacgcccagauccguucgcagcgugcccggagaaaugcggcuugcgucuaucgccuuuaaccacccuauucaggucgaccagcucaauagcuccuacuucaagcugucuaucccgaccaacuuuagcuucggcgugacacaagaguauauccagaccacaauucagaaggugaccgucgauuguaaacaguacguuugcaauggguuccaaaagugcgaacagcugcucagagaguauggacaguuuuguuccaagaucaaccaggcucugcauggcgccaaucuucgccaagacgauucugugcggaaccuguucgcuagcgugaaauccucucagagcucccccauuaucccuggguuuggcggagacuucaaucucacgcugcuggagcccgucagcauuucuacaggcuccagaagcgcccgcucugcgaucgaagaccuucucuuugauaaggugaccaucgccgacccuggguacaugcagggauacgaugacugcaugcagcaaggccccgcuuccgcccgggaucugauuugugcucaguauguugccggguacaaagugcugccuccccucauggacgucaacauggaggccgcuuauaccagcucccugcuuggaucuaucgcgggcgugggguggacagccggccugagcuccuucgcugccauuccguuugcccagagcaucuucuacagacucaauggaguuggcauuacccaacaggugcugucugaaaaccagaagcugaucgcuaauaaauuuaaccaggcccuuggggcgaugcaaacaggauucacgaccacaaaugaggcuuuucggaagguccaggaugccgugaacaacaaugcccaggcucucuccaagcuggccagcgaacugucuaacaccuucggcgcgaucagcgcuuccauuggggacaucauucagcgccucgauguucuggagcaagacgcccagaucgauagacuuauuaauggacggcugacaacccucaacgccuucguggcucagcagcuggucagaucugagagcgccgcucuguccgcccaacuugcgaaagacaaggugaaugaaugcgugaaagcccagucuaagcgcagcggcuuuuguggccaggggacgcacaucgucuccuucguugugaacgcuccuaauggacuguauuuuaugcaugugggcuacuaucccagcaaccacaucgaggucgugucugccuacgggcucugcgaugcugccaauccuaccaacuguauugcccccguuaauggauacuucaucaaaacaaacaauacccggauuguggacgaaugguccuauacaggcagcuccuuuuacgcuccggagccuaucaccucucugaacacaaaguaugucgcgccccaggugaccuaccaaaauauuagcacgaaccucccuccuccccugcuugggaacuccacaggaaucgacuuccaggaugagcuggacgaauuuuucaagaauguuucuaccagcauucccaacuuuggcucccucacccagaucaauacaacccugcuggaucuuacguaugagaugcugagccuccaacagguggucaaagcccugaacgaaucuuacaucgaccucaaggagcugggcaauuauacauacuacaacaaauggccgugguauauuuggcuuggguucaucgcuggacugguggcccucgcccugugcgucuuuuucauucuguguugcaccggcugugggacaaauugcaugggaaaacuuaagugcaacagauguugcgaucgcuacgaagaguaugaccuggagccccauaaggugcacguucacuga

SEQ ID NO: 919 - RNA, 4062 nt, Artificial Sequence
  derived and/or modified CDS sequence (opt5) from MERS-CoV__AGV08455__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcuacggcaagauggggcgguucuuuaaucauacacuuguccugcucccggauggauguggcacccugcugcgcgcguucuauugcauccucgagcccagaucugggaaccacuguccugccggaaauuccuacacgagcuuugcuacauaucauacccccgccacagacugcucugauggcaacuacaaucggaacgcuucccugaauagcuucaaggaauauuucaaccuucgcaauuguaccuuuauguacaccuauaacauuacagaggacgaaauccuggagugguucggcaucacgcagaccgcccaaggggugcaccucuuuuccucuagauacguggaucuguacggaggcaauauguuccaguuugcgacacuuccugucuaugacaccauuaaauacuauagcaucauuccccacuccauccggagcauucagucugaccgcaaggccugggcugccuucuacguuuauaaacugcagccgcucacauuucugcuggauuucuccguggacggguacaucagacgggcuaucgauugcggauuuaacgaccucagccaacugcauuguucuuaugagagcuucgauguggaauccggcgucuacucugugagcuccuuugaggccaagccuagcgggucuguuguggaacaggccgagggagucgagugcgacuucagcccccuucuguccggcaccccuccccagguguacaacuuuaaacgccucguuuucacgaauuguaacuauaaucugacaaaacuucugucucucuucuccgugaacgauuuuaccugcagccaaauuucccccgcugcgaucgccucuaauuguuacagcucccugauucuggacuauuucucuuacccucucagcaugaaguccgaucugagcgucucuuccgcuggcccgaucagccaguuuaacuauaagcagucuuucuccaauccuaccugccuuauucuggccacagugccccacaaccucaccacaaucacgaagccccugaaauacagcuauaucaauaagugcucuagacuucugagcgacgaucggaccgaagucccucagcucgugaacgccaaucaauacucccccuguguuagcauugugccgucuacagucugggaggacggggacuacuaucgcaaacagcuguccccucuggaaggaggcggguggcucguggcuagcggauccaccguugccaugacagagcagcugcagaugggcuuugggaucaccgugcaauacggcacggauaccaacucugucugccccaaacuugaguucgcgaaugacacaaagauugcuagccagcugggaaacuguguggaauauucccucuacggcgugucugggagaggaguuuuucagaauugcaccgccgucggcgugcggcagcaaagauucguguaugaugccuaccagaaccuggucggguauuacagcgacgauggaaacuacuauugucugcgcgcuugcguguccguuccugugucugucaucuacgacaaggagacaaagacccaugccacgcuuuuuggcagcguggcuugugaacacauuuccagcacaaugucucaguauucccggagcaccagaucuaugcucaaacgccgggauuccacauacgggccccugcagaccccuguuggcugcgugcugggacucgucaauagcucucuguucguggaggacuguaaacuuccccugggccaaucccucugcgcccugccggauaccccuagcacacugacgcccagauccguucgcagcgugcccggggaaaugcggcuugcgucuaucgccuuuaaccacccuauucaggucgaccagcucaauagcuccuauuucaagcugucuaucccgaccaacuuuagcuucggagugacacaagaguacauccagaccacaauucagaaggugaccgucgauuguaaacaguauguuugcaauggcuuccaaaagugcgaacagcugcucagagaguacgggcaguuuuguuccaagaucaaccaggcucugcauggagccaaucuucgccaagacgauucugugcggaaccuguucgcuagcgugaaauccucucagagcucccccauuaucccuggcuuugggggcgacuucaaucucacgcugcuggagcccgucagcauuucuacaggauccagaagcgcccgcucugcgaucgaagaccuucucuuugauaaggugaccaucgccgacccuggcuacaugcagggguaugaugacugcaugcagcaaggacccgcuuccgcccgggaucugauuugugcucaguacguugccggcuauaaagugcugccuccccucauggacgucaacauggaggccgcuuacaccagcucccugcuugggucuaucgcgggagugggcuggacagccgggcugagcuccuucgcugccauuccguuugcccagagcaucuucuauagacucaauggcguuggaauuacccaacaggugcugucugaaaaccagaagcugaucgcuaauaaauuuaaccaggcccuuggcgcgaugcaaacaggguucacgaccacaaaugaggcuuuucggaagguccaggaugccgugaacaacaaugcccaggcucucuccaagcuggccagcgaacugucuaacaccuucggagcgaucagcgcuuccauuggcgacaucauucagcgccucgauguucuggagcaagacgcccagaucgauagacuuauuaaugggcggcugacaacccucaacgccuucguggcucagcagcuggucagaucugagagcgccgcucuguccgcccaacuugcgaaagacaaggugaaugaaugcgugaaagcccagucuaagcgcagcggauuuuguggccagggcacgcacaucgucuccuucguugugaacgcuccuaaugggcuguacuuuaugcaugugggauauuaccccagcaaccacaucgaggucgugucugccuacggccucugcgaugcugccaauccuaccaacuguauugcccccguuaauggguauuucaucaaaacaaacaauacccggauuguggacgaaugguccuacacaggaagcuccuuuuaugcuccggagccuaucaccucucugaacacaaaguacgucgcgccccaggugaccuaucaaaauauuagcacgaaccucccuccuccccugcuuggcaacuccacagggaucgacuuccaggaugagcuggacgaauuuuucaagaauguuucuaccagcauucccaacuuuggaucccucacccagaucaauacaacccugcuggaucuuacguacgagaugcugagccuccaacagguggucaaagcccugaacgaaucuuauaucgaccucaaggagcugggcaauuacacauacuauaacaaauggccgugguacauuuggcuuggcuucaucgcugggcugguggcccucgcccugugcgucuuuuucauucuguguugcaccggauguggcacaaauugcauggggaaacuuaagugcaacagauguugcgaucgcuaugaagaguacgaccuggagccccauaaggugcacguucacuga

SEQ ID NO: 920 - RNA, 4062 nt, Artificial Sequence
  derived and/or modified CDS sequence (opt5) from MERS-CoV__AGV08467__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaagacccaugccacgcuuuuuggcagcguggcuugugaacacauuuccagcacaaugucucaguacucccggagcaccagaucuaugcucaaacgccgggacuccacauaugggccccugcagaccccuguuggcugcgugcugggacucgucaauagcucucuguucguggaggauuguaaacuuccccugggccaaucccucugcgcccugccggacaccccuagcacacugacgcccagauccguucgcagcgugcccggggaaaugcggcuugcgucuaucgccuuuaaccacccuauucaggucgaucagcucaauagcuccuacuucaagcugucuaucccgaccaacuuuagcuucggagugacacaagaguauauccagaccacaauucagaaggugaccgucgacuguaaacaguacguuugcaauggcuuccaaaagugcgaacagcugcucagagaguaugggcaguuuuguuccaagaucaaccaggcucugcauggagccaaucuucgccaagaugacucugugcggaaccuguucgcuagcgugaaauccucucagagcucccccauuaucccuggcuuugggggcgacuucaaucucacgcugcuggagcccgucagcauuucuacaggauccagaagcgcccgcucugcgaucgaagaucuucucuuugacaaggugaccaucgccgauccuggcuacaugcagggguacgacgauugcaugcagcaaggacccgcuuccgcccgggaccugauuugugcucaguauguugccggcuacaaagugcugccuccccucauggaugucaacauggaggccgcuuauaccagcucccugcuugggucuaucgcgggagugggcuggacagccgggcugagcuccuucgcugccauuccguuugcccagagcaucuucuacagacucaauggcguuggaauuacccaacaggugcugucugaaaaccagaagcugaucgcuaauaaauuuaaccaggcccuuggcgcgaugcaaacaggguucacgaccacaaaugaggcuuuucggaagguccaggacgccgugaacaacaaugcccaggcucucuccaagcuggccagcgaacugucuaacaccuucggagcgaucagcgcuuccauuggcgauaucauucagcgccucgacguucuggagcaagaugcccagaucgacagacuuauuaaugggcggcugacaacccucaacgccuucguggcucagcagcuggucagaucugagagcgccgcucuguccgcccaacuugcgaaagauaaggugaaugaaugcgugaaagcccagucuaagcgcagcggauuuuguggccagggcacgcacaucgucuccuucguugugaacgcuccuaaugggcuguauuuuaugcaugugggauacuaucccagcaaccacaucgaggucgugucugccuacggccucugcgacgcugccaauccuaccaacuguauugcccccguuaauggguacuucaucaaaacaaacaauacccggauuguggacgaaugguccuauacaggaagcuccuuuuacgcuccggagccuaucaccucucugaacacaaaguaugucgcgccccaggugaccuaccaaaauauuagcacgaaccucccuccuccccugcuuggcaacuccaucgggauugauuuccaggacgagcuggaugaauuuuucaagaauguuucuacaagcauccccaacuuuggaucccucacccagaucaauaccacacugcuggaccuuaccuaugagaugcugagccuccaacagguggucaaagcccugaacgaaucuuacauugaucucaaggagcugggcaauuauacguacuacaacaaauggccgugguauaucuggcuuggcuucauugcugggcugguggcccucgcccugugcgucuuuuucauccuguguugcacaggauguggcaccaauugcauggggaaacuuaagugcaacagauguugcgaccgcuacgaagaguaugaucuggagccccauaaggugcacguucacuga

SEQ ID NO: 921 - RNA, 4062 nt, Artificial Sequence
  derived and/or modified CDS sequence (opt5) from MERS-CoV__AGV08492__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaagacccaugccacgcuuuuuggcagcguggcuugugaacacauuuccagcacaaugucucaguacucccggagcaccagaucuaugcucaaacgccgggacuccacauaugggccccugcagaccccuguuggcugcgugcugggacucgucaauagcucucuguucguggaggauuguaaacuuccccugggccaaucccucugcgcccugccggacaccccuagcacacugacgcccagauccguucgcagcgugcccggggaaaugcggcuugcgucuaucgccuuuaaccacccuauucaggucgaucagcucaauagcuccuacuucaagcugucuaucccgaccaacuuuagcuucggagugacacaagaguauauccagaccacaauucagaaggugaccgucgacuguaaacaguacguuugcaauggcuuccaaaagugcgaacagcugcucagagaguaugggcaguuuuguuccaagaucaaccaggcucugcauggagccaaucuucgccaagaugacucugugcggaaccuguucgcuagcgugaaauccucucagagcucccccauuaucccuggcuuugggggcgacuucaaucucacgcugcuggagcccgucagcauuucuacaggauccagaagcgcccgcucugcgaucgaagaucuucucuuugacaaggugaccaucgccgauccuggcuacaugcagggguacgacgauugcaugcagcaaggacccgcuuccgcccgggaccugauuugugcucaguauguugccggcuacaaagugcugccuccccucauggaugucaacauggaggccgcuuauaccagcucccugcuugggucuaucgcgggagugggcuggacagccgggcugagcuccuucgcugccauuccguuugcccagagcaucuucuacagacucaauggcguuggaauuacccaacaggugcugucugaaaaccagaagcugaucgcuaauaaauuuaaccaggcccuuggcgcgaugcaaacaggguucacgaccacaaaugaggcuuuucggaagguccaggacgccgugaacaacaaugcccaggcucucuccaagcuggccagcgaacugucuaacaccuucggagcgaucagcgcuuccauuggcgauaucauucagcgccucgacguucuggagcaagaugcccagaucgacagacuuauuaaugggcggcugacaacccucaacgccuucgugucucagcagcuggucagaagcgaguccgcugcccugucugcucaacuugccaaagauaaggugaaugaaugcgugaaagcgcagagcaagcgcuccggauuuuguggccagggcacgcacaucgucagcuucguugugaacgccccuaaugggcuguauuuuaugcaugugggauacuaucccucuaaccacaucgaggucguguccgcuuacggccucugcgacgccgcuaauccuaccaacuguauugcccccguuaauggguacuucaucaaaacaaacaauacccggauuguggacgaauggagcuauacaggauccucuuuuuacgccccggagccuaucaccagccugaacacaaaguaugucgcuccccaugugaccuaccagaauauuuccacgaaccucccuccuccccugcuuggcaacucuacagggaucgauuuccaagacgagcuggaugaauuuuucaagaauguuagcaccuccauucccaacuuuggaagccucacccagaucaauacaacccugcuggaccuuacguaugagaugcugucucuccagcaaguggucaaagcgcugaacgaauccuacaucgaucucaaggagcugggcaauuauacauacuacaacaaauggccgugguauauuuggcuuggcuucaucgccgggcugguggcucucgcccugugcgucuuuuucauucuguguugcaccggauguggcacaaauugcauggggaaacuuaagugcaacagauguugcgaccgcuacgaagaguaugaucuggagccccacaaggugcacguucauuga

SEQ ID NO: 922 - RNA, 4062 nt, Artificial Sequence
  derived and/or modified CDS sequence (opt5) from MERS-CoV__AGV08584__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagcuugggaggacggggauuacuaccgcaaacagcuguccccucuggaaggaggcggguggcucgucgccagcggauccaccguggcgaugacagagcagcugcagaugggcuuugggaucaccguucaauauggcacggacaccaacucugugugccccaaacuugaguucgcuaaugauacaaagauugccagccagcugggaaacugugucgaauacucccucuauggcgugucugggagaggaguguuucagaauugcaccgccguuggcguccggcagcaaagauucguguacgacgcuuaucagaaccuggugggguacuauagcgaugacggaaacuacuacugucugcgcgccugcgucuccgugccuguuucugugaucuaugauaaggagacaaagacccaugcuacgcuuuuuggcagcgucgccugugaacacauuuccagcacaaugucucaguacucccggagcaccagaucuaugcucaaacgccgggacuccacauaugggccccugcagaccccugugggcugcguucugggacucgugaauagcucucuguucgucgaggauuguaaacuuccccugggccaaucccucugcgcgcugccggacaccccuagcacacugacgcccagauccgugcgcagcguucccggggaaaugcggcuugccucuaucgcuuuuaaccacccuauucagguggaucagcucaauagcuccuacuucaagcugucuaucccgaccaacuuuagcuucggagucacacaagaguauauccagaccacaauucagaaggugaccguggacuguaaacaguacgucugcaauggcuuccaaaagugcgaacagcugcucagagaguaugggcaguuuuguuccaagaucaaccaggcccugcauggagcuaaucuucgccaagaugacucuguucggaaccuguucgccagcgugaaauccucucagagcucccccauuaucccuggcuuugggggcgacuucaaucucacgcugcuggagcccgugagcauuucuacaggauccagaagcgcgcgcucugccaucgaagaucuucucuuugacaaggucaccaucgcugauccuggcuacaugcagggguacgacgauugcaugcagcaaggacccgccuccgcucgggaccugauuugugcccaguauguggccggcuacaaaguucugccuccccucauggaugugaacauggaggcugcguauaccagcucccugcuugggucuaucgccggagucggcuggacagcugggcugagcuccuucgccgccauuccguuugcucagagcaucuucuacagacucaauggcgugggaauuacccaacagguucugucugaaaaccagaagcugaucgccaauaaauuuaaccaggcgcuuggcgcuaugcaaacaggguucacgaccacaaaugaggccuuucggaaggugcaggacgccgucaacaacaaugcucaggcccucuccaagcuggcgagcgaacugucuaacaccuucggagcuaucagcgccuccauuggcgauaucauucagcgccucgacgugcuggagcaagaugcccagaucgacagacuuauuaaugggcggcugacaacccucaacgcuuucguugcccagcagcuggugagaucugagagcgcugcccuguccgcgcaacuugccaaagauaaggucaaugaaugcgugaaagcucagucuaagcgcagcggauuuuguggccagggcacgcacaucguguccuucgucguuaacgccccuaaugggcuguauuuuaugcaugugggauacuaucccagcaaccacaucgagguggucucugcuuacggccucugcgacgccgccaauccuaccaacuguauugcucccgugaauggguacuucaucaaaacaaacaauacccggauuguugacgaaugguccuauacaggaagcuccuuuuacgcgccggagccuaucaccucucugaacacaaaguauguggcuccccaggucaccuaccaaaauauuagcacgaaccucccuccuccccugcuuggcaacuccacagggaucgauuuccaggacgagcuggaugaauuuuucaagaaugugucuaccagcauucccaacuuuggaucccucacccagaucaauacaacccugcuggaccuuacguaugagaugcugagccuccaacagguugugaaagcccugaacgaaucuuacaucgaucucaaggagcugggcaauuauacauacuacaacaaauggccgugguauauuuggcuuggcuucaucgccgggcuggucgcccucgcucugugcguguuuuucauucuguguugcaccggauguggcacaaauugcauggggaaacuuaagugcaacagauguugcgaccgcuacgaagaguaugaucuggagccccauaagguccacgugcacuga

SEQ ID NO: 923 - RNA, 4062 nt, Artificial Sequence
  derived and/or modified CDS sequence (opt5) from MERS-CoV__AHB33326__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccuacucuacgggcaccguuaucauuagccccuccacaagcgcuaccaucagaaaaauuuacccugccuucaugcuggggucuuccgugggaaauuuuagcgauggcaagauggggcgguucuuuaaccauacacuuguccugcucccggacggauguggcacccugcugcgcgcguucuauugcauccucgagcccagaucugggaaucacuguccugccggaaacuccuacacgagcuuugcuacauaucauacccccgccacagauugcucugacggcaauuacaaccggaaugcuucccugaacagcuucaaggaauauuucaaucuucgcaacuguaccuuuauguacaccuauaauauuacagaggaugaaauccuggagugguucggcaucacgcagaccgcccaaggggugcaccucuuuuccucuagauacguggaccuguacggaggcaacauguuccaguuugcgacacuuccugucuaugacaccauuaaauacuauagcaucauuccccacuccauccggagcauucagucugaucgcaaggccugggcugccuucuacguuuauaaacugcagccgcucacauuucugcuggacuucuccguggauggguacaucagacgggcuaucgacugcggauuuaaugaucucagccaacugcauuguucuuaugagagcuucgacguggaauccggcgucuacucugugagcuccuuugaggccaagccuagcgggucuguuguggaacaggccgagggagucgagugcgauuucagcccccuucuguccggcaccccuccccagguguacaacuuuaaacgccucguuuucacgaacuguaauuauaaccugacaaaacuucugucucucuucuccgugaaugacuuuaccugcagccaaauuucccccgcugcgaucgccucuaacuguuacagcucccugauucuggauuauuucucuuacccucucagcaugaaguccgaccugagcgucucuuccgcuggcccgaucagccaguuuaauuauaagcagucuuucuccaacccuaccugccuuauucuggccacagugccccacaaucucaccacaaucacgaagccccugaaauacagcuauaucaacaagugcucuagacuucugagcgaugaccggaccgaagucccucagcucgugaaugccaaccaauacucccccuguguuagcauugugccgucuacagucugggaggacggggauuacuaucgcaaacagcuguccccucuggaaggaggcggguggcucguggcuagcggauccaccguugccaugacagagcagcugcagaugggcuuugggaucaccgugcaauacggcacggacaccaauucugucugccccaaacuugaguucgcgaacgauacaaagauugcuagccagcugggaaauuguguggaauauucccucuacggcgugucugggagaggaguuuuucagaacugcaccgccgucggcgugcggcagcaaagauucguguaugacgccuaccagaaucuggucggguauuacagcgaugacggaaacuacuauugucugcgcgcuugcguguccguuccugugucugucaucuacgauaaggagacaaagacccaugccacgcuuuuuggcagcguggcuugugaacacauuuccagcacaaugucucaguauucccggagcaccagaucuaugcucaaacgccgggacuccacauacgggccccugcagaccccuguuggcugcgugcugggacucgucaacagcucucuguucguggaggauuguaaacuuccccugggccaaucccucugcgcccugccggacaccccuagcacacugacgcccagauccguucgcagcgugcccggggaaaugcggcuugcgucuaucgccuuuaaucacccuauucaggucgaucagcucaacagcuccuauuucaagcugucuaucccgaccaauuuuagcuucggagugacacaagaguacauccagaccacaauucagaaggugaccgucgacuguaaacaguauguuugcaacggcuuccaaaagugcgaacagcugcucagagaguacgggcaguuuuguuccaagaucaaucaggcucugcauggagccaaccuucgccaagaugacucugugcggaaucuguucgcuagcgugaaauccucucagagcucccccauuaucccuggcuuugggggcgacuucaaccucacgcugcuggagcccgucagcauuucuacaggauccagaagcgcccgcucugcgaucgaagaucuucucuuugacaaggugaccaucgccgauccuggcuacaugcagggguaugacgauugcaugcaccagggacccgcuuccgcccgggaccugauuugugcucaauacguugccggcuauaaagugcugccuccccucauggaugucaauauggaggccgcuuacaccagcucccugcuugggucuaucgcgggagugggcuggacagccgggcugagcuccuucgcugccauuccguuugcccagagcaucuucuauagacucaacggcguuggaauuacccagcaagugcugucugaaaaucagaagcugaucgcuaacaaauuuaaucaggcccuuggcgcgaugcagacaggguucacgaccacaaacgaggcuuuucggaagguccaagacgccgugaauaacaacgcccaggcucucuccaagcuggccagcgaacugucuaauaccuucggagcgaucagcgcuuccauuggcgauaucauucagcgccucgacguucuggagcaggaugcccaaaucgacagacuuauuaacgggcggcugacaacccucaaugccuucguggcucagcagcuggucagaucugagagcgccgcucuguccgcccagcuugcgaaagauaaggugaacgaaugcgugaaagcccaaucuaagcgcagcggauuuuguggccagggcacgcauaucgucuccuucguugugaaugcuccuaacgggcuguacuuuaugcacgugggauauuaccccagcaaucauaucgaggucgugucugccuacggccucugcgacgcugccaacccuaccaauuguauugcccccguuaacggguauuucaucaaaacaaauaacacccggauuguggacgaaugguccuacacaggaagcuccuuuuauucuccggagccuaucaccagccugaauacaaaguacgucgcuccccaggugaccuaucagaacauuuccacgaaucucccuccuccccugcuuggcaacucuacagggaucgauuuccaagacgagcuggaugaauuuuucaagaacguuagcaccuccauucccaauuuuggaagccucacccagaucaacacaacccugcuggaccuuacguacgagaugcugucucuccagcaaguggucaaagcgcugaaugaauccuauaucgaucucaaggagcugggcaacuacacauacuauaauaaauggccgugguacauuuggcuuggcuucaucgccgggcugguggcucucgcccugugcgucuuuuucauucuguguugcaccggauguggcacaaacugcauggggaaacuuaagugcaauagauguugcgaccgcuaugaagaguacgaucuggagccccacaaggugcacguucauuga

SEQ ID NO: 924 - RNA, 4062 nt, Artificial Sequence
  derived and/or modified CDS sequence (opt5) from MERS-CoV__AHC74088__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuuugcuggcccgaucucccaguucaacuacaagcagagcuuuucuaauccuaccugccuuauucuggccacagugccccacaaccucaccacaaucacgaagccccugaaauauuccuacaucaauaagugcagcagacuucugucugaugaccggaccgaagucccucagcucgugaacgccaaucaauauagccccuguguuuccauugugccgagcacagucugggaggacggggauuacuaccgcaaacagcugucuccucuggaaggaggcggguggcucguggcuuccggaagcaccguugccaugacagagcagcugcagaugggcuucgggaucaccgugcaauauggcacggacaccaacuccgucugccccaaacuugaauuugcgaaugauacaaagauugcuucucagcugggaaacuguguggaguacagccucuauggcguguccgggagaggaguuuuccagaauugcaccgccgucggcgugcggcagcaaagauuuguguacgacgccuaucagaaccuggucggguacuauucugaugacggaaacuacuacugucugcgcgcuugcgugagcguuccuguguccgucaucuaugauaaggagacaaagacccaugccacgcuuuucggcucuguggcuugugaacacauuagcuccacaaugagccaguacucucgguccaccagaagcaugcucaaacgccgggacucuacauaugggccccugcagaccccuguuggcugcgugcugggacucgucaauuccagccuguuuguggaggauuguaaacuuccccugggccaaucucucugcgcccugccggacaccccuuccacacugacgcccagaagcguucgcuccgugcccggggaaaugcggcuugcgagcaucgccuucaaccacccuauucaggucgaucagcucaauucuagcuacuuuaagcuguccaucccgaccaacuucucuuucggagugacacaagaguauauccagaccacaauucagaaggugaccgucgacuguaaacaguacguuugcaauggcuuucaaaagugcgaacagcugcucagagaguaugggcaguucuguagcaagaucaaccaggcucugcauggagccaaucuucgccaagaugacuccgugcggaaccuguuugcuucugugaaaagcucccagucuagccccauuaucccuggcuucgggggcgacuuuaaucucacgcugcuggagcccgucuccauuagcacaggaucuagauccgcccgcagcgcgaucgaagaucuucucuucgacaaggugaccaucgccgauccuggcuacaugcagggguacgacgauugcaugcagcaaggacccgcuucugcccgggaccugauuugugcucaguauguugccggcuacaaagugcugccuccccucauggaugucaacauggaggccgcuuauaccuccagccugcuuggguccaucgcgggagugggcuggacagccgggcugucuagcuuugcugccauuccguucgcccaguccaucuuuuacagacucaauggcguuggaauuacccaacaggugcugagcgaaaaccagaagcugaucgcuaauaaauucaaccaggcccuuggcgcgaugcaaacaggguuuacgaccacaaaugaggcuuuccggaagguccaggacgccgugaacaacaaugcccaggcucucucuaagcuggccuccgaacugagcaacaccuucggagcgaucucugcuagcauuggcgauaucauucagcgccucgacguucuggagcaagaugcccagaucgacagacuuauuaaugggcggcugacaacccucaacgccuuuguggcucagcagcuggucagauccgagucugccgcucugagcgcccaacuugcgaaagauaaggugaaugaaugcgugaaagcccaguccaagcgcucuggauucuguggccagggcacgcacaucgucagcuuuguugugaacgcuccuaaugggcuguauuucaugcaugugggauacuaucccuccaaccacaucgaggucgugagcgccuacggccucugcgacgcugccaauccuaccaacuguauugcccccguuaauggguacuuuaucaaaacaaacaauacccggauuguggacgaauggucuuauacaggauccagcuucuacgcuccggagccuaucaccucccugaacacaaaguaugucgcgccccaggugaccuaccaaaauauuucuacgaaccucccuccuccccugcuuggcaacagcacagggaucgauuuucaggacgagcuggaugaguucuuuaagaauguuuccaccucuauucccaacuucggaagccucacccagaucaauacaacccugcuggaccuuacguaugaaaugcugucccuccaacagguggucaaagcccugaacgaaagcuacaucgaucucaaggagcugggcaauuauacauacuacaacaaauggccgugguauauuuggcuuggcuuuaucgcugggcugguggcccucgcccugugcgucuucuuuauucuguguugcaccggauguggcacaaauugcauggggaaacuuaagugcaacagauguugcgaccgcuacgaagaguaugaucuggagccccauaaggugcacguucacuga

SEQ ID NO: 925 - RNA, 4062 nt, Artificial Sequence
  derived and/or modified CDS sequence (opt5) from MERS-CoV__AHI48528__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaagcuccugucucucuucuccgugaacgacuuuaccugcagccaaauuucucccccugcuaucgcguccaauuguuauagcucccugauucuggauuacuucucuuauccgcucagcaugaaguccgaccugagcgucucuuccgccggccccaucagccaguuuaacuacaaacagucuuucuccaauccuaccugccuuauucuggugacagucccccacaaccucaccacaaucacgaagccucugaaauauagcuacaucaauaagugcucuagacuucugagcgaugaccggaccgaagugccccagcucguuaacgcuaaucaauauuccccgugugugagcauugucccuucuacagugugggaggacggggauuacuaccgcaaacagcugagcccccuggaaggaggcggguggcucguugccuccggauccaccguggccaugacagagcagcugcagaugggcuuugggaucaccguccaauauggcacggacaccaacucugugugcccuaaacuugaguucgcuaaugauacaaagauugccagccagcugggaaacuguguggaauacucccucuauggcguuucugggagaggagucuuucagaauugcaccgcggugggcgugcggcagcaaagauucgucuacgacgcuuaucagaaccuggugggguacuauagcgaugacggaaacuacuacugucugcgcgccugcguuuccgugcccgucucugugaucuaugauaaggagacaaagacccaugccacgcuuuuuggcagcguugcuugugaacacauuuccagcacaaugucucaguacucccggagcaccagaucuaugcucaaacgccgggacuccacauaugggccucugcagacccccgugggcugcguccugggacucgugaauagcucucuguucguugaggauuguaaacuuccgcugggccaaucccucugcgcccugccugacacccccagcacacugacgcccagauccgugcgcagcgucccuggggaaaugcggcuugcuucuaucgccuuuaaccacccgauucagguggaucagcucaauagcuccuacuucaagcugucuauccccaccaacuuuagcuucggagugacacaagaguauauccagaccacaauucagaaggucaccguugacuguaaacaguacgugugcaauggcuuccaaaagugcgaacagcugcucagagaguaugggcaguuuuguuccaagaucaaccaggcgcugcauggagccaaucuucgccaagaugacucugugcggaaccuguucgcuagcgucaaauccucucagagcuccccuauuauccccggcuuugggggcgacuucaaucucacgcugcuggagccugugagcauuucuacaggauccagaagcgcccgcucugcuaucgaagaucuucucuuugacaagguuaccaucgccgaucccggcuacaugcagggguacgacgauugcaugcagcaaggaccugcguccgcccgggaccugauuugugcucaguauguggccggcuacaaaguccugcccccgcucauggaugugaacauggaggcugccuauaccagcucccugcuugggucuaucgccggaguuggcuggacagcugggcugagcuccuucgcggccauuccuuuugcucagagcaucuucuacagacucaauggcgugggaauuacccaacagguccugucugaaaaccagaagcugaucgccaauaaauuuaaccaggcccuuggcgcuaugcaaacaggguucacgaccacaaaugaggccuuucggaaggugcaggacgcgguuaacaacaaugcucaggcccucuccaagcuggccagcgaacugucuaacaccuucggagcuaucagcgccuccauuggcgauaucauucagcgccucgacgugcuggagcaagaugcgcagaucgacagacuuauuaaugggcggcugacaacccucaacgcuuucgucgcccagcagcuggugagaucugagagcgccgcucuguccgcccaacuugcuaaagauaaggugaaugaaugcgucaaagcccagucuaagcgcagcggauuuuguggccagggcacgcacaucguuuccuucguggugaacgcgcccaaugggcuguauuuuaugcaugucggauacuauccuagcaaccacaucgaggugguuucugccuacggccucugcgacgcugccaaucccaccaacuguauugcuccggugaauggguacuucaucaaaacaaacaauacccggauugucgacgaaugguccuauacaggaagcuccuuuuacgccccugagcccaucaccucucugaacacaaaguauguggccccucagguuaccuaccaaaauauuagcacgaaccuucccccuccccugcuuggcaacuccacagggaucgauuuccaggacgagcuggaugaauuuuucaagaaugugucuaccagcauuccgaacuuuggaucccucacccagaucaauacaacccugcuggaccuuacguaugagaugcugagccuccaacaggucgugaaagcucugaacgaaucuuacaucgaucucaaggagcugggcaauuauacauacuacaacaaauggcccugguauauuuggcuuggcuucaucgcggggcuggucgcccucgcucugugcguguuuuucauucuguguugcaccggauguggcacaaauugcauggggaaacuuaagugcaacagauguugcgaccgcuacgaagaguaugaucuggagccucauaagguucacgugcacuga

SEQ ID NO: 926 - RNA, 4062 nt, Artificial Sequence
  derived and/or modified CDS sequence (opt5) from MERS-CoV__AHI48550__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaagacccaugccacgcuuuuuggcagcguggcuugugaacacauuuccagcacaaugucucaguacucccggagcaccagaucuaugcucaaacgccgggacuccacauaugggccccugcagaccccuguuggcugcgugcugggacucgucaauagcucucuguucguggaggauuguaaacuuccccugggccaaucccucugcgcccugccggacaccccuagcacacugacgcccagauccguucgcagcgugcccggggaaaugcggcuugcgucuaucgccuuuaaccacccuauucaggucgaucagcucaauagcuccuacuucaagcugucuaucccgaccaacuuuagcuucggagugacacaagaguauauccagaccacaauucagaaggugaccgucgacuguaaacaguacguuugcaauggcuuccaaaagugcgaacagcugcucagagaguaugggcaguuuuguuccaagaucaaccaggcucugcauggagccaaucuucgccaagaugacucugugcggaaccuguucgcuagcgugaaauccucucagagcucccccauuaucccuggcuuugggggcgacuucaaucucacgcugcuggagcccgucagcauuucuacaggauccagaagcgcccgcucugcgaucgaagaucuucucuuugacaaggugaccaucgccgauccuggcuacaugcagggguacgacgauugcaugcagcaaggacccgcuuccgcccgggaccugauuugugcucaguauguugccggcuacaaagugcugccuccccucauggaugucaacauggaggccgcuuauaccagcucccugcuugggucuaucgcgggagugggcuggacagccgggcugagcuccuucgcugccauuccguuugcccagagcaucuucuacagacucaauggcguuggaauuacccaacaggugcugucugaaaaccagaagcugaucgcuaauaaauuuaaccaggcccuuggcgcgaugcaaacaggguucacgaccacaaaugaggcuuuucacaagguccaggacgccgugaacaacaaugcccaggcucucuccaagcuggccagcgaacugucuaacaccuucggagcgaucagcgcuuccauuggcgauaucauucagcggcucgacguucuggagcaagaugcccagaucgaccgccuuauuaaugggagacugacaacccucaacgccuucguggcucagcagcugguccggucugagagcgccgcucuguccgcccaacuugcgaaagauaaggugaaugaaugcgugaaagcccagucuaagagaagcggauuuuguggccagggcacgcauaucgucuccuucguugugaacgcuccuaaugggcuguauuuuaugcacgugggauacuaucccagcaaccauaucgaggucgugucugccuacggccucugcgacgcugccaauccuaccaacuguauugcccccguuaauggguacuucaucaaaacaaacaauacccgcauuguggacgaaugguccuauacaggaagcuccuuuuacgcuccggagccuaucaccucucugaacacaaaguaugucgcgccccaggugaccuaccaaaauauuagcacgaaccucccuccuccccugcuuggcaacuccacagggaucgauuuccaggacgagcuggaugaauuuuucaagaauguuucuaccagcauucccaacuuuggaucccucacccagaucaauacaacccugcuggaccuuacguaugagaugcugagccuccaacagguggucaaagcccugaacgaaucuuacaucgaucucaaggagcugggcaauuauacauacuacaacaaauggccgugguauauuuggcuuggcuucaucgcugggcugguggcccucgcccugugcgucuuuuucauucuguguugcaccggauguggcacaaauugcauggggaaacuuaagugcaaccgguguugcgacagauacgaagaguaugaucugcagccccacaaggugcacguucauuga

SEQ ID NO: 927 - RNA, 4062 nt, Artificial Sequence
  derived and/or modified CDS sequence (opt5) from MERS-CoV__AHI48583__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguucaaggcugaugggaucauuuauccucagggacggacauacuccaacaucaccaucacauaucagggccuguuucccuaccagggggaccauggagauauguauguguacucugccggccacgcgaccgggacaaccccucaaaaacucuucguugcuaauuauagccaggacgugaagcaguuugccaacggauucgucgugcgcauuggcgccgcugccaauuccacgggcaccguuaucauuucucccagcacauccgcuaccaucagaaaaauuuacccugccuuuaugcuggggagcucugugggaaacuucuccgauggcaagauggggcgguuuuucaaucauacacuuguccugcucccggacggauguggcacccugcugcgcgcguuuuacugcauccucgagcccagaagcgggaaccacuguccugccggaaauucuuauacguccuucgcuacauaccauacccccgccacagauugcagcgacggcaacuauaaucggaacgcuucucuuaauuccuucaaggaauacuuuaaccuucgcaauuguaccuucauguauaccuacaacauuacagaggaugaaauccuggagugguuuggcaucacgcagaccgcccaaggggugcaccucuucagcuccagauauguggaccuguacggaggcaauauguuucaguucgcgacacuuccugucuacgacaccauuaaauauuacucuaucauuccccacagcauccgguccauucagagcgaucgcaaggccugggcugccuuuuauguuuacaaacugcagccgcucacauuccugcuggacuuuucuguggauggguauaucagacgggcuaucgacugcggauucaacgaucucucccaacugcauuguagcuacgagucuuuugacguggaaagcggcgucuauuccgugucuagcuucgaggccaagccuuccgggagcguuguggaacaggccgagggagucgagugcgauuuuucuccccuucuguccggcaccccuccccagguguacaacuucaaacgccucguuuucacgaauuguaacuacaaucugacaaagcugcugagccucuuuucugugaacgacuuuaccugcucccaaauuagccccgcugcgaucgccuccaauuguuauucuagccugauucuggauuacuucuccuauccucucucuaugaaaagcgaccuguccgucagcucugcuggcccgaucucccaguucaacuacaagcagagcuuuucuaauccuaccugccuuauucuggccacagugccccacaaccucaccacaaucacgaagccccugaaauauuccuacaucaauaagugcagcagacuucugucugaugaccggaccgaagucccucagcucgugaacgccaaucaauauagccccuguguuuccauugugccgagcacagucugggaggacggggauuacuaccgcaaacagcugucuccucuggaaggaggcggguggcucguggcuuccggaagcaccguugccaugacagagcagcugcagaugggcuucgggaucaccgugcaauauggcacggacaccaacuccgucugccccaaacuugaauuugcgaaugauacaaagauugcuucucagcugggaaacuguguggaguacagccucuauggcguguccgggagaggaguuuuccagaauugcaccgccgucggcgugcggcagcaaagauuuguguacgacgccuaucagaaccuggucggguacuauucugaugacggaaacuacuacugucugcgcgcuugcgugagcguuccuguguccgucaucuaugauaaggagacaaagacccaugccacgcuuuucggcucuguggcuugugaacacauuagcuccacaaugagccaguacucucgguccaccagaagcaugcucaaacgccgggacucuacauaugggccccugcagaccccuguuggcugcgugcugggacucgucaauuccagccuguuuguggaggauuguaaacuuccccugggccaaucucucugcgcccugccggacaccccuuccacacugacgcccagaagcguucgcuccgugcccggggaaaugcggcuugcgagcaucgccuucaaccacccuauucaggucgaucagcucaauucuagcuacuuuaagcuguccaucccgaccaacuucucuuucggagugacacaagaguauauccagaccacaauucagaaggugaccgucgacuguaaacaguacguuugcaauggcuuucaaaagugcgaacagcugcucagagaguaugggcaguucuguagcaagaucaaccaggcucugcauggagccaaucuucgccaagaugacuccgugcggaaccuguuugcuucugugaaaagcucccagucuagccccauuaucccuggcuucgggggcgacuuuaaucucacgcugcuggagcccgucuccauuagcacaggaucuagauccgcccgcagcgcgaucgaagaucuucucuucgacaaggugaccaucgccgauccuggcuacaugcagggguacgacgauugcaugcagcaaggacccgcuucugcccgggaccugauuugugcucaguauguugccggcuacaaagugcugccuccccucauggaugucaacauggaggccgcuuauaccuccagccugcuuggguccaucgcgggagugggcuggacagccgggcugucuagcuuugcugccauuccguucgcccaguccaucuuuuacagacucaauggcguuggaauuacccaacaggugcugagcgaaaaccagaagcugaucgcuaauaaauucaaccaggcccuuggcgcgaugcaaacaggguuuacgaccacaaaugaggcuuuccacaagguccaggacgccgugaacaacaaugcccaggcucucucuaagcuggccuccgaacugagcaacaccuucggagcgaucucugcuagcauuggcgauaucauucagcggcucgacguucuggagcaagaugcccagaucgaccgccuuauuaaugggagacugacaacccucaacgccuuuguggcucagcagcugguccgguccgagucugccgcucugagcgcccaacuugcgaaagauaaggugaaugaaugcgugaaagcccaguccaagagaucuggauucuguggccagggcacgcauaucgucagcuuuguugugaacgcuccuaaugggcuguauuucaugcacgugggauacuaucccuccaaccauaucgaggucgugagcgccuacggccucugcgacgcugccaauccuaccaacuguauugcccccguuaauggguacuuuaucaaaacaaacaauacccgcauuguggacgaauggucuuauacaggauccagcuucuacgcuccggagccuaucaccucccugaacacaaaguaugucgcgccccaggugaccuaccaaaauauuucuacgaaccucccuccuccccugcuuggcaacagcacagggaucgauuuucaggacgagcuggaugaguucuuuaagaauguuuccaccucuauucccaacuucggaagccucacccagaucaauacaacccugcuggaccuuacguaugaaaugcugucccuccaacagguggucaaagcccugaacgaaagcuacaucgaucucaaggagcugggcaauuauacauacuacaacaaauggccgugguauauuuggcuuggcuuuaucgcugggcugguggcccucgcccugugcgucuucuuuauucuguguugcaccggauguggcacaaauugcauggggaaacuuaagugcaaccgguguugcgacagauacgaagaguaugaucuggagccccacaaggugcacguucauuga

SEQ ID NO: 928 - RNA, 4062 nt, Artificial Sequence
  derived and/or modified CDS sequence (opt5) from MERS-CoV__AHI48605__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaagacccaugccacgcuuuuuggcagcguggcuugugaacacauuuccagcacaaugucucaguacucccggagcaccagaucuaugcucaaacgccgggacuccacauaugggccccugcagaccccuguuggcugcgugcugggacucgucaauagcucucuguucguggaggauuguaaacuuccccugggccaaucccucugcgcccugccggacaccccuagcacacugacgcccagauccguucgcagcgugcccggggaaaugcggcuugcgucuaucgccuuuaaccacccuauucaggucgaucagcucaauagcuccuacuucaagcugucuaucccgaccaacuuuagcuucggagugacacaagaguauauccagaccacaauucagaaggugaccgucgacuguaaacaguacguuugcaauggcuuccaaaagugcgaacagcugcucagagaguaugggcaguuuuguuccaagaucaaccaggcucugcauggagccaaucuucgccaagaugacucugugcggaaccuguucgcuagcgugaaauccucucagagcucccccauuaucccuggcuuugggggcgacuucaaucucacgcugcuggagcccgucagcauuucuacaggauccagaagcgcccgcucugcgaucgaagaucuucucuuugacaaggugaccaucgccgauccuggcuacaugcagggguacgacgauugcaugcagcaaggacccgcuuccgcccgggaccugauuugugcucaguauguugccggcuacaaagugcugccuccccucauggaugucaacauggaggccgcuuauaccagcucccugcuugggucuaucgcgggagugggcuggacagccgggcugagcuccuucgcugccauuccguuugcccagagcaucuucuacagacucaauggcguuggaauuacccaacaggugcugucugaaaaccagaagcugaucgcuaauaaauuuaaccaggcccuuggcgcgaugcaaacaggguucacgaccacaaaugaggcuuuucacaagguccaggacgccgugaacaacaaugcccaggcucucuccaagcuggccagcgaacugucuaacaccuucggagcgaucagcgcuuccauuggcgauaucauucagcggcucgacguucuggagcaagaugcccagaucgaccgccuuauuaaugggagacugacaacccucaacgccuucguggcucagcagcugguccggucugagagcgccgcucuguccgcccaacuugcgaaagauaaggugaaugaaugcgugaaagcccagucuaagagaagcggauuuuguggccagggcacgcauaucgucuccuucguugugaacgcuccuaaugggcuguauuuuaugcacgugggauacuaucccagcaaccauaucgaggucgugucugccuacggccucugcgacgcugccaauccuaccaacuguauugcccccguuaauggguacuucaucaaaacaaacaauacccgcauuguggacgaaugguccuauacaggaagcuccuuuuacgcuccggagccuaucaccucucugaacacaaaguaugucgcgccccaggugaccuaccaaaauauuagcacgaaccucccuccuccccugcuuggcaacuccacagggaucgauuuccaggacgagcuggaugaauuuuucaagaauguuucuaccagcauucccaacuuuggaucccucacccagaucaauacaacccugcuggaccuuacguaugagaugcugagccuccaacagguggucaaagcccugaacgaaucuuacaucgaucucaaggagcugggcaauuauacauacuacaacaaauggccgugguauauuuggcuuggcuucaucgcugggcugguggcccucgcccugugcgucuuuuucauucuguguugcaccggauguggcacaaauugcauggggaaacuuaagugcaaccgguguugcgacagauacgaagaguaugaucuggagccccacaaggugcacguucauuga

SEQ ID NO: 929 - RNA, 4062 nt, Artificial Sequence
  derived and/or modified CDS sequence (opt5) from MERS-CoV__AHY21469__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccguuacaaccccucaaaaacucuuuguggcuaauuauucccaggacgucaagcaguucgccaacggguuugugguucgcauuggagccgcugccaauucuacgggcaccgugaucauuagccccuccacaagcgcuaccaucagaaaaauuuacccugccuucaugcuggggucuuccgucgggaacuuuagcgauggaaagaugggccgguucuuuaaucauacacuugugcugcucccggacggguguggaacccugcugcgcgcguucuacugcauccucgagcccagaucuggcaacuauuguccugccggcaauuccuacacgagcuuugcuacauaucacacccccgccacagauugcucugacggaaacuacaaucggaacgcuucccugaauagcuucaaggaauauuucaaccuucgcaauuguaccuuuauguacaccuauaacauuacagaggaugaaauccuggagugguucggcaucacgcagaccgcccaaggcgugcaucucuuuuccucuagauacgucgaccuguacgggggaaauauguuccaguuugcgacacuuccuguuuaugacaccauuaaauacuauagcaucauuccccacuccauccugagcauucagucugaucggaaggccugggcugccuucuacguguauaaacuccagccgcugacauuucugcucgacuucuccguggauggcuacauccgcagagcuaucgacugcggguuuaacgaucugagccaacuucacuguucuuaugagagcuucgacgucgaauccggaguguacucuguuagcuccuuugaggccaagccuagcggcucuguggucgaacaggccgaggggguggagugcgauuucagcccccugcucuccggaaccccuccccagguuuacaacuuuaaacggcugguguucacgaauuguaacuauaaucuuacaaagcugcucucucuguucuccgucaacgacuuuaccugcagccaaauuucccccgcugcgaucgccucuaauuguuacagcucccugauucucgauuauuucucuuacccucugagcaugaaguccgaccuuagcgugucuuccgcuggcccgaucagccaguuuaacuauaaacagucuuucuccaauccuaccugccugauucucgccacagucccccauaaccugaccacaaucacgaagccccuuaaauacagcuauaucaauaagugcucucgccugcucagcgaugacagaaccgaagugccucagcugguuaacgccaaucaauacucccccugugugagcauugucccgucuacagugugggaggacggcgauuacuaucggaaacagcuguccccucucgaagggggaggcuggcugguugcuagcggguccaccguggccaugacagagcagcuucagaugggauuuggcaucaccguccaauacgggacggacaccaacucugugugccccaagcuggaguucgcgaaugauacaaaaauugcuagccagcucggcaacuguguggaauauucccuguacggaguuucuggccgcggggucuuucagaauugcaccgccgugggagugagacagcaacgguucgucuaugacgccuaccagaaccuggugggcuauuacagcgaugacgggaacuacuauugucuuagagcuugcguuuccgugccugucucugugaucuacgauaaggagacaaagacccacgccacgcucuuuggaagcguugcuugugaacauauuuccagcacaaugucucaguauucccgcagcacccggucuaugcugaaaagacgcgacuccacauacggcccccugcagaccccuguggggugcguccucggccuggugaauagcucucuuuucguugaggauuguaagcugccccucggacaaucccugugcgcccugccggacaccccuagcacacuuacgccccgguccgugagaagcguccccggcgaaaugcgccucgcgucuaucgccuuuaaccacccuauucagguggaucagcugaauagcuccuauuucaaacugucuaucccgaccaacuuuagcuucggggugacacaagaguacauccagaccacaauucagaaggucaccguugacuguaaacaguaugugugcaauggauuccaaaagugcgaacagcuccugcgggaguacggccaguuuuguuccaagaucaaccaggcccuucacggggcuaaucugagacaagaugacucugugcgcaaccucuucgcuagcgucaaauccucucagagcucccccauuaucccuggauuuggcggggacuucaaucugacgcugcuugagcccgugagcacaucuaccggcucccggagcgccagaucugcgauugaagaucuccuguuugacaagguuaccaucgccgauccuggauacaugcagggcuaugacgauugcaugcagcaagggcccgcuuccgcccgcgaccugaucugugcucaguacguggccggauauaaaguccucccuccccugauggaugugaacauggaggccgcuuacacaagcucccuucugggcucuauugcggggguuggauggaccgccggccucagcuccuucgcugccaucccguuugcccagagcauuuucuaucggcugaauggggugggcaucacacaacagguccugucugaaaaccagaaacuuauugcuaauaaguuuaaccaggcccucggagcgaugcaaacgggcuucaccacaaccaaugaggcuuuucagaaggugcaggacgccguuaacaacaaugcccaggcucuguccaagcuggccagcgaacucucuaacacauucggggcgaucagcgcuuccaucggagauauuauccaaagacuggacgugcuugagcaggaugcccagauugaccggcugaucaauggccgccucaccacgcugaacgccuucgucgcucagcaacuggugagaucugagagcgccgcucuuuccgcccagcuggcgaaagauaaggugaaugaaugcgucaaagcccagucuaagcggagcggguuuuguggacagggcacccauauuguuuccuucguggugaacgcuccuaauggccucuacuuuaugcacgucggguauuaccccagcaaccauaucgaggugguuucugccuacggacugugcgacuccgcuaauccuacaaacuguaucgcccccgugaauggcuauuucauuaaaaccaacaauacaagaaucgucgacgaauggagcuacaccggguccucuuuuuaugccccggagccuauuacaagccucaacaccaaguacguggcuccccaaguuacguaucagaauaucuccacaaaccugccuccuccccuucugggaaacucuaccggcauugauuuccaggacgagcucgaugaauuuuucaagaaugugagcaccuccauccccaacuuugggagccugacacaaauuaauaccacgcugcuugaccugacauacgagaugcucucucugcagcaggucgugaaagcgcucaacgaauccuauaucgaucugaaggagcuuggaaauuacaccuacuauaacaaauggccgugguacaucuggcugggcuucauugccggccucgucgcucuggcccugugcguguuuuucauccuuuguugcacaggguguggaaccaauugcaugggcaagcugaaaugcaaccgcuguugcgaccgguaugaagaguacgaucucgagccccacaagguucaugugcacuga

SEQ ID NO: 930 - RNA, 4062 nt, Artificial Sequence
  derived and/or modified CDS sequence (opt5) from MERS-CoV__AHZ64057__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaagacccaugccacgcuuuuuggcagcguggcuugugaacacauuuucuccacaaugagccaguacucucgguccaccagaagcaugcucaaacgccgggacucuacauaugggccccugcagaccccuguuggcugcgugcugggacucgucaauuccagccuguuuguggaggauuguaaacuuccccugggccaaucucucugcgcccugccggacaccccuuccacacugacgcccagaagcguucgcuccgugcccggggaaaugcggcuugcgagcaucgccuucaaccacccuauucaggucgaucagcucaauucuagcuacuuuaagcuguccaucccgaccaacuucucuuucggagugacacaagaguauauccagaccacaauucagaaggugaccgucgacuguaaacaguacguuugcaauggcuuucaaaagugcgaacagcugcucagagaguaugggcaguucuguagcaagaucaaccgcgcucugcauggagccaaucuucggcaggaugacuccgugagaaaccuguuugcuucugugaaaagcucccaaucuagccccauuaucccuggcuucgggggcgacuuuaaucucacgcugcuggagcccgucuccauuagcacaggaucucgcuccgcccggagcgcgaucgaagaucuucucuucgacaaggugaccaucgccgauccuggcuacaugcagggguacgacgauugcaugcagcagggacccgcuucugccagagaccugauuugugcucaauauguugccggcuacaaagugcugccuccccucauggaugucaacauggaggccgcuuauaccuccagccugcuuggguccaucgcgggagugggcuggacagccgggcugucuagcuuugcugccauuccguucgcccaguccaucuuuuaccggcucaauggcguuggaauuacccagcaagugcugagcgaaaaccagaagcugaucgcuaauaaauucaaccaggcccuuggcgcgaugcagacaggguuuacgaccacaaaugaggcuuuccgcaagguccaagacgccgugaacaacaaugcccaggcucucucuaagcuggccuccgaacugagcaacaccuucggagcgaucucugcuagcauuggcgauaucauucagagacucgacguucuggagcaggaugcccaaaucgaccggcuuauuaaugggagacugacaacccucaacgccuuuguggcucagcagcugguccgcuccgagucugccgcucugagcgcccagcuugcgaaagauaaggugaaugaaugcgugaaagcccaauccaagcggucuggauucuguggccagggcacgcacaucgucagcuuuguugugaacgcuccuaaugggcuguauuucaugcaugugggauacuaucccuccaaccacaucgaggucgugagcgccuacggccucugcgacgcugccaauccuaccaacuguauugcccccguuaauggguacuuuaucaaaacaaacaauaccagaauuguggacgaauggucuuauacaggauccagcuucuacgcuccggagccuaucaccucccugaacacaaaguaugucgcgccccaggugaccuaccagaauauuucuacgaaccucccuccuccccugcuuggcaacagcacagggaucgauuuucaagacgagcuggaugaguucuuuaagaauguuuccaccucuauucccaacuucggaagccucacccagaucaauacaacccugcuggaccuuacguaugaaaugcugucccuccagcaaguggucaaagcccugaacgaaagcuacaucgaucucaaggagcugggcaauuauacauacuacaacaaauggccgugguauauuuggcuuggcuuuaucgcugggcugguggcccucgcccugugcgucuucuuuauucuguguugcaccggauguggcacaaauugcauggggaaacuuaagugcaaccgcuguugcgacagauacgaagaguaugaucuggagccccauaaggugcacguucacuga

SEQ ID NO: 931 - RNA, 4062 nt, Artificial Sequence
  derived and/or modified CDS sequence (opt5) from MERS-CoV__AID50418__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaagacccaugccacgcuuuuuggcagcguggcuugugaacacauuuccagcacaaugucucaguacucccggagcaccagaucuaugcucaaacgccgggacuccacauaugggccccugcagaccccuguuggcugcgugcugggacucgucaauagcucucuguucguggaggauuguaaacuuccccugggccaaucccucugcgcccugccggacaccccuagcacacugacgcccagauccguucgcagcgugcccggggaaaugcggcuugcgucuaucgccuuuaaccacccuauucaggucgaucagcucaauagcuccuacuucaagcugucuaucccgaccaacuuuagcuucggagugacacaagaguauauccagaccacaauucagaaggugaccgucgacuguaaacaguacguuugcaauggcuuccaaaagugcgaacagcugcucagagaguaugggcaguuuuguuccaagaucaaccaggcucugcauggagccaaucuucgccaagaugacucugugcggaaccuguucgcuagcgugaaauccucucagagcucccccauuaucccuggcuuugggggcgacuucaaucucacgcugcuggagcccgucagcauuucuacaggauccagaagcgcccgcucugcgaucgaagaucuucucuuugacaaggugaccaucgccgauccuggcuacaugcagggguacgacgauugcaugcagcaaggacccgcuuccgcccgggaccugauuugugcucaguauguugccggcuacaaagugcugccuccccucauggaugucaacauggaggccgcuuauaccagcucccugcuugggucuaucgcgggagugggcuggacagccgggcugagcuccuucgcugccauuccguuugcccagagcaucuucuacagacucaauggcguuggaauuacccaacaggugcugucugaaaaccagaagcugaucgcuaauaaauuuaaccaggcccuuggcgcgaugcaaacaggguucacgaccacaaaugaggcuuuucggaagguccaggacgccgugaacaacaaugcccaggcucucuccaagcuggccagcgaacugucuaacaccuucggagcgaucagcgcuuccauuggcgauaucauucagcgccucgacguucuggagcaagaugcccagaucgacagacuuauuaaugggcggcugacaacccucaacgccuucguggcucagcagcuggucagaucugagagcgccgcucuguccgcccaacuugcgaaagauaaggugaaugaaugcgugaaagcccagucuaagcgcagcggauuuuguggccagggcacgcacaucgucuccuucguugugaacgcuccuaaugggcuguauuuuaugcaugugggauacuaucccagcaaccacaucgaggucgugucugccuacggccucugcgacgcugccaauccuaccaacuguauugcccccguuaauggguacuucaucaaaacaaacaauacccggauuguggacgaaugguccuauacaggaagcuccuuuuacgcuccggagccuaucaccucucugaacacaaaguaugucgcgccccaggugaccuaccaaaauauuagcacgaaccucccuccuccccugcuuggcaacuccacagggaucgauuuccaggacgagcuggaugaauuuuucaagaauguuucuaccagcauucccaacuuuggaucccucacccagaucaauacaacccugcuggaccuuacguaugagaugcugagccuccaacagguggucaaagcccugaacgaaucuuacaucgaucucaaggagcugggcaauuauacauacuacaacaaauggccgugguauauuuggcuuggcuucaucgcugggcugguggcccucgcccugugcgucuuuuucauucuguguugcaccggauguggcacaaauugcauggggaaacuuaagugcaacagauguugcgaccgcuacgaagaguaugaucuggagccccauaaggugcacguucacuga

SEQ ID NO: 932 - RNA, 4062 nt, Artificial Sequence
  derived and/or modified CDS sequence (opt5) from MERS-CoV__AID55068__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaagacccaugccacgcuuuuuggcagcguggcuugugaacacauuuccagcacaaugucucaguacucccggagcaccagaucuaugcucaaacgccgggacuccacauaugggccccugcagaccccuguuggcugcgugcugggacucgucaauagcucucuguucguggaggauuguaaacuuccccugggccaaucccucugcgcccugccggacaccccuagcacacugacgcccagauccguucgcagcgugcccggggaaaugcggcuugcgucuaucgccuuuaaccacccuauucaggucgaucagcucaauagcuccuacuucaagcugucuaucccgaccaacuuuagcuucggagugacacaagaguauauccagaccacaauucagaaggugaccgucgacuguaaacaguacguuugcaauggcuuccaaaagugcgaacagcugcucagagaguaugggcaguuuuguuccaagaucaaccgcgcucugcauggagccaaucuucggcaggaugacucugugagaaaccuguucgcuagcgugaaauccucucaaagcucccccauuaucccuggcuuugggggcgacuucaaucucacgcugcuggagcccgucagcauuucuacaggaucccgcagcgcccggucugcgaucgaagaucuucucuuugacaaggugaccaucgccgauccuggcuacaugcagggguacgacgauugcaugcagcagggacccgcuuccgccagagaccugauuugugcucaauauguugccggcuacaaagugcugccuccccucauggaugucaacauggaggccgcuuauaccagcucccugcuugggucuaucgcgggagugggcuggacagccgggcugagcuccuucgcugccauuccguuugcccagagcaucuucuaccggcucaauggcguuggaauuacccagcaagugcugucugaaaaccagaagcugaucgcuaauaaauuuaaccaggcccuuggcgcgaugcagacaggguucacgaccacaaaugaggcuuuucgcaagguccaagacgccgugaacaacaaugcccaggcucucuccaagcuggccagcgaacugucuaacaccuucggagcgaucagcgcuuccauuggcgauaucauucagagacucgacguucuggagcaggaugcccaaaucgaccggcuuauuaaugggagacugacaacccucaacgccuucguggcucagcagcugguccgcucugagagcgccgcucuguccgcccagcuugcgaaagauaaggugaaugaaugcgugaaagcccaaucuaagcggagcggauuuuguggccagggcacgcacaucgucuccuucguugugaacgcuccuaaugggcuguauuuuaugcaugugggauacuaucccagcaaccacaucgaggucgugucugccuacggccucugcgacgcugccaauccuaccaacuguauugcccccguuaauggguacuucaucaaaacaaacaauaccagaauuguggacgaaugguccuauacaggaagcuccuuuuacgcuccggagccuaucaccucucugaacacaaaguaugucgcgccccaggugaccuaccagaauauuagcacgaaccucccuccuccccugcuuggcaacuccacagggaucgauuuccaagacgagcuggaugaauuuuucaagaauguuucuaccagcauucccaacuuuggaucccucacccagaucaauacaacccugcuggaccuuacguaugagaugcugagccuccagcaaguggucaaagcccugaacgaaucuuacaucgaucucaaggagcugggcaauuauacauacuacaacaaauggccgugguauauuuggcuuggcuucaucgcugggcugguggcccucgcccugugcgucuuuuucauucuguguugcaccggauguggcacaaauugcauggggaaacuuaagugcaaccgcuguugcgacagauacgaagaguaugaucuggagccccauaaggugcacguucacuga

SEQ ID NO: 933 - RNA, 4062 nt, Artificial Sequence
  derived and/or modified CDS sequence (opt5) from MERS-CoV__AID55073__S
augauccacagcguguuccugcucauguuucugcuuacccccacagaguccuacgucgacguuggcccugauucugugaaguccgccugcauugaaguggacauccagcaaacguucuuugauaaaaccuggccgagacccauugacgucuccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucugagcggcaccccuccccagguguacaacuuuaaacgccucguuuucacgaauuguaacuacaauuucacaaagcugcuuucucuguuuuccgugaacgacuuuaccugcagccaaauuucccccgcugcgaucgccucuaauuguuauagcucccucauucuggauuacuucucuuauccucugagcaugaaguccgaccucagcgucucuuccgcuggcccgaucagccaguucaacuacaaacagucuuuuuccaauccuaccugccugauucuugccacagugccccacaaccugaccacaaucacgaagccccucaaauauagcuacaucaauaagugcucuagacugcuuagcgaugaccggaccgaagucccucagcuggugaacgccaaucaauauucccccuguguuagcauugugccgucuacagucugggaggacggggauuacuaccgcaaacagcucuccccucuggaaggaggcggguggcugguggcuagcggauccaccguugccaugacagagcagcuccagaugggcuucgggaucaccgugcaauauggcacggacaccaacucugucugccccaagcuggaauuugcgaaugauacaaaaauugcuagccagcuuggaaacuguguggaguacucccuguauggcgugucugggagaggaguuuuccagaauugcaccgccgucggcgugcggcagcaaagauuuguguacgacgccuaucagaaccucgucggguacuauagcgaugacggaaacuacuacugucugcgcgcuugcguguccguuccugugucugucaucuaugauaaggagacaaagacccaugccacgcuguucggcagcguggcuugugaacacauuuccagcacaaugucucaguacucccggagcaccagaucuaugcuuaaacgccgggacuccacauaugggccccuccagaccccuguuggcugcgugcugggacuggucaauagcucucucuuuguggaggauuguaagcugccccuuggccaaucccugugcgcccucccggacaccccuagcacacugacgcccagauccguucgcagcgugcccggggaaaugcggcuggcgucuaucgccuucaaccacccuauucaggucgaucagcuuaauagcuccuacuuuaaacucucuaucccgaccaacuucagcuucggagugacacaagaguauauccagaccacaauucagaaggugaccgucgacuguaaacaguacguuugcaauggcuuucaaaagugcgaacagcugcugagagaguaugggcaguucuguuccaagaucaaccaggcucuccauggagccaaucugcgccaagaugacucugugcggaaccuuuuugcuagcgugaaauccucucagagcucccccauuaucccuggcuucgggggcgacuuuaaucugacgcuccuggagcccgucagcauuucuacaggauccagaagcgcccgcucugcgaucgaagaucugcuuuucgacaaggugaccaucgccgauccuggcuacaugcagggguacgacgauugcaugcagcaaggacccgcuuccgcccgggaccucauuugugcucaguauguugccggcuacaaagugcugccuccccugauggaugucaacauggaggccgcuuauaccagcucccuccuggggucuaucgcgggagugggcuggacagccgggcuuagcuccuuugcugccauuccguucgcccagagcaucuuuuacagacugaauggcguuggaauuacccaacaggugcucucugaaaaccagaagcugaucgcuaauaaauucaaccaggcccugggcgcgaugcaaacaggguuuacgaccacaaaugaggcuuuccggaagguccaggacgccgugaacaacaaugcccaggcucuuuccaagcucgccagcgaacugucuaacaccuucggagcgaucagcgcuuccauuggcgauaucauucagcgccuggacguucucgagcaagaugcccagaucgacagacugauuaaugggcggcuuacaacccugaacgccuuuguggcucagcagcucgucagaucugagagcgccgcucuguccgcccaacuggcgaaagauaaggugaaugaaugcgugaaagcccagucuaagcgcagcggauucuguggccagggcacgcacaucgucuccuuuguugugaacgcuccuaaugggcuuuauuucaugcaugugggauacuaucccagcaaccacaucgaggucgugucugccuacggccugugcgacgcugccaauccuaccaacuguauugcccccguuaauggguacuuuaucaaaacaaacaauacccggauuguggacgaaugguccuauacaggaagcuccuucuacgcuccggagccuaucaccucucucaacacaaaguaugucgcgccccaggugaccuaccaaaauauuagcacgaaccugccuccuccccuccugggcaacuccacagggaucgauuuucaggacgagcuugaugaguucuuuaagaauguuucuaccagcauucccaacuucggaucccugacccagaucaauacaacccuccuggaccugacguaugaaaugcuuagccugcaacagguggucaaagcccucaacgaaucuuacaucgaucugaaggagcucggcaauuauacauacuacaacaaauggccgugguauauuuggcugggcuuuaucgcugggcuuguggcccuggcccucugcgucuucuuuauucuguguugcaccggauguggcacaaauugcauggggaagcugaaaugcaacagauguugcgaccgcuacgaagaguaugaucuugagccccauaaggugcacguucacuga

SEQ ID NO: 934 - RNA, 4062 nt, Artificial Sequence
  derived and/or modified CDS sequence (opt5) from MERS-CoV__AIY60528__S
augauccacagcguguuccugcucauguuucugcuuacccccacagaguccuacgucgacguuggcccugauucuuucaagagcgccugcauugaaguggacauccagcaaacguuuuucgauaaaaccuggccgagacccauugacguguccaaggcugaugggaucauuuauccucagggacggacauacucuaacaucaccaucacauaucagggccuguuucccuaccagggggaccauggagauauguaugucuacagcgccggccacgcgaccgggacaaccccucaaaaacucuucguggcuaauuauucccagaacguuaagcaguuugccaauggauucgugguccgcauuggcgccgcugccaacucuacgggcaccgugaucauuagccccuccacaagcgcuaccaucagaaaaauuuacccugccuuuaugcuggggucuuccguuggaaauuucagcgacggcaagauggggcgguuuuucaaccauacacuugugcugcucccggauggauguggcacccugcugcgcgcguuuuacugcauccucgagcccagaucugggaaucacuguccugccggaaacuccuauacgagcuucgcuacauaccauacccccgccacagacugcucugauggcaauuauaaccggaaugcuucccugaacagcuucaaggaauacuuuaaucuucgcaacuguaccuucauguauaccuacaauauuacagaggacgaaauccuggagugguuuggcaucacgcagaccgcccaagggguccaccucuucuccucuagauauguggaucuguacggaggcaacauguuucaguucgcgacacuuccuguguacgacaccauuaaauauuacagcaucauuccccacuccauccggagcauucagucugaccgcaaggccugggcugccuuuuaugucuacaaacugcagccgcucacauuccugcuggauuuuuccguugacggguauaucagacgggcuaucgauugcggauucaacgaccucagccaacugcauuguucuuacgagagcuuugauguggaauccggcguguauucugucagcuccuucgaggccaagccuagcgggucugugguugaacaggccgagggaguggagugcgacuuuagcccccuucuguccggcaccccuccccaggucuacaauuucaaacgccucguguucacgaacuguaauuacaaccugacaaaacuucugucucucuuuuccguuaaugauuuuaccugcagccaaauuucccccgcugcgaucgccucuaacuguuauagcucccugauucuggacuacuucucuuauccucucagcaugaaguccgaucugagcgugucuuccgcuggcccgaucagccaguucaauuacaagcagucuuuuuccaacccuaccugccuuauucuggccacagucccccacaaucucaccacaaucacgaagccccugaaauauagcuacaucaacaagugcucuagacuucugagcgacgaucggaccgaagugccucagcucgucaaugccaaccaauauucccccugugugagcauuguuccgucuacagugugggaggacggggacuacuaccgcaaacagcuguccccucuggaaggaggcggguggcucgucgcuagcggauccaccguggccaugacagagcagcugcagaugggcuucgggaucaccguucaauauggcacggauaccaauucugugugccccaaacuugaauuugcgaacgacacaaagauugcuagccagcugggaaauugugucgaguacucccucuauggcgugucugggagaggaguguuccagaacugcaccgccguuggcguccggcagcaaagauuuguguacgaugccuaucagaaccuggugggguacuauagcgacgauggaaauuacuacugucugcgcgcuugcgucuccgugccuguuucugugaucuaugacaaggagacaaagacccaugccacgcuuuucggcagcgucgcuugugaacacauuuccagcacaaugucucaguacucccggagcaccagaucuaugcucaaacgccgggauuccacauaugggccccugcagaccccugugggcugcguucugggacucgugaacagcucucuguuugucgaggacuguaaacuuccccugggccaaucccucugcgcccugccggauaccccuagcacacugacgcccagauccgugcgcagcguucccggggaaaugcggcuugcgucuaucgccuucaaucacccuauucagguggaccagcucaacagcuccuacuuuaagcugucuaucccgaccaauuucagcuucggagucacacaagaguauauccagaccacaauucagaaggugaccguggauuguaaacaguacgucugcaacggcuuucaaaagugcgaacagcugcucagagaguaugggcaguucuguuccaagaucaaucaggcucugcauggagccaaccuucgccaagacgauucuguucggaaucuguuugcuagcgugaaauccucucagagcucccccauuaucccuggcuucgggggcgacuuuaaccucacgcugcuggagcccgugagcauuucuacaggauccagaagcgcccgcucugcgaucgaagaccuucucuucgauaaggucaccaucgccgacccuggcuacaugcagggguacgaugacugcaugcagcaaggacccgcuuccgcccgggaucugauuugugcucaguauguggccggcuacaaaguucugccuccccucauggacgugaauauggaggccgcuuauaccagcucccugcuugggucuaucgcgggagucggcuggacagccgggcugagcuccuuugcugccauuccguucgcccagagcaucuuuuacagacucaacggcgugggaauuacccaacagguucugucugaaaaucagaagcugaucgcuaacaaauucaaucaggcccuuggcgcgaugcaaacaggguuuacgaccacaaacgaggcuuuccggaaggugcaggaugccgucaacaauaacgcccaggcucucuccaagcuggccagcgaacugucuaauaccuucggagcgaucagcgcuuccauuggcgacaucauucagcgccucgaugugcuggagcaagacgcccagaucgauagacuuauuaacgggcggcugacaacccucaaugccuuuguugcucagcagcuggugagaucugagagcgccgcucuguccgcccaacuugcgaaagacaaggucaacgaaugcgugaaagcccagucuaagcgcagcggauucuguggccagggcacgcacaucguguccuuugucguuaaugcuccuaacgggcuguauuucaugcaugugggauacuaucccagcaaucacaucgagguggucucugccuacggccucugcgaugcugccaacccuaccaauuguauugcccccgugaacggguacuuuaucaaaacaaauaacacccggauuguugacgaaugguccuauacaggaagcuccuucuacucuccggagccuaucaccagccugaauacaaaguauguggcuccccaggucaccuaccaaaacauuuccacgaaccucccuccuccccugcuuggcaauucuacagggaucgacuuucaggaugagcuggacgaguucuuuaagaacgugagcaccuccauucccaauuucggaagccucacccagaucaacacaacccugcuggaucuuacguaugaaaugcugucucuccaacagguugugaaagcgcugaaugaauccuacaucgaccucaaggagcugggcaacuauacauacuacaauaaauggccgugguauauuuggcuuggcuuuaucgccgggcuggucgcucucgcccugugcguguucuuuauucuguguugcaccggauguggcacaaacugcauggggaaacuuaagugcaauagauguugcgaucgcuacgaagaguaugaccuggagccccauaagguccacgugcacuga

SEQ ID NO: 935 - RNA, 4062 nt, Artificial Sequence
  derived and/or modified CDS sequence (opt5) from MERS-CoV__AIY60558__S
augauccacagcguguuccugcucauguuucugcuuacccccacagaguccuacgucgacguuggcccugauucuuucaagagcgccugcauugaaguggacauccagcaaacguuuuucgauaaaaccuggccgagacccauugacguguccaaggcugaugggaucauuuauccucagggacggacauacucuaacaucaccaucacauaucagggccuguuucccuaccagggggaccauggagauauguaugucuacagcgccggccacgcgaccgggacaaccccucaaaaacucuucguggcuaauuauucccaggacguuaagcaguuugccaacggauucgugguccgcauuggcgccgcugccaauucuacgggcaccgugaucauuagccccuccacaagcgcuaccaucagaaaaauuuacccugccuuuaugcuggggucuuccguuggaaacuucagcgauggcaagauggggcgguuuuucaaucauacacuugugcugcucccggacggauguggcacccugcugcgcgcguuuuacugcauccucgagcccagaucugggaaccacuguccugccggaaauuccuauacgagcuucgcuacauaccauacccccgccacagauugcucugacggcaacuauaaucggaacgcuucccugaauagcuucaaggaauacuuuaaccuucgcaauuguaccuucauguauaccuacaacauuacagaggaugaaauccuggagugguuuggcaucacgcagaccgcccaagggguccaccucuucuccucuagauauguggaccuguacggaggcaauauguuucaguucgcgacacuuccuguguacgacaccauuaaauauuacagcaucauuccccacuccauccggagcauucagucugaucgcaaggccugggcugccuuuuaugucuacaaacugcagccgcucacauuccugcuggacuuuuccguugauggguauaucagacgggcuaucgacugcggauucaacgaucucagccaacugcauuguucuuacgagagcuuugacguggaauccggcguguauucugucagcuccuucgaggccaagccuagcgggucugugguugaacaggccgagggaguggagugcgauuuuagcccccuucuguccggcaccccuccccaggucuacaacuucaaacgccucguguucacgaauuguaacuacaaucugacaaaacuucugucucucuuuuccguuaacgacuuuaccugcagccaaauuucccccgcugcgaucgccucuaauuguuauagcucccugauucuggauuacuucucuuauccucucagcaugaaguccgaccugagcgugucuuccgcuggcccgaucagccaguucaacuacaagcagucuuuuuccaauccuaccugccuuauucuggccacagucccccacaaccucaccacaaucacgaagccccugaaauauagcuacaucaauaagugcucuagacuucugagcgaugaccggaccgaagugccucagcucgucaacgccaaucaauauucccccugugugagcauuguuccgucuacagugugggaggacggggauuacuaccgcaaacagcuguccccucuggaaggaggcggguggcucgucgcuagcggauccaccguggccaugacagagcagcugcagaugggcuucgggaucaccguucaauauggcacggacaccaacucugugugccccaaacuugaauuugcgaaugauacaaagauugcuagccagcugggaaacugugucgaguacucccucuauggcgugucugggagaggaguguuccagaauugcaccgccguuggcguccggcagcaaagauuuguguacgacgccuaucagaaccuggugggguacuauagcgaugacggaaacuacuacugucugcgcgcuugcgucuccgugccuguuucugugaucuaugauaaggagacaaagacccaugccacgcuuuucggcagcgucgcuugugaacacauuuccagcacaaugucucaguacucccggagcaccagaucuaugcucaaacgccgggacuccacauaugggccccugcagaccccugugggcugcguucugggacucgugaauagcucucuguuugucgaggauuguaaacuuccccugggccaaucccucugcgcccugccggacaccccuagcacacugacgcccagauccgugcgcagcguucccggggaaaugcggcuugcgucuaucgccuucaaccacccuauucagguggaucagcucaauagcuccuacuuuaagcugucuaucccgaccaacuucagcuucggagucacacaagaguauauccagaccacaauucagaaggugaccguggacuguaaacaguacgucugcaauggcuuucaaaagugcgaacagcugcucagagaguaugggcaguucuguuccaagaucaaccaggcucugcauggagccaaucuucgccaagaugacucuguucggaaccuguuugcuagcgugaaauccucucagagcucccccauuaucccuggcuucgggggcgacuuuaaucucacgcugcuggagcccgugagcauuucuacaggauccagaagcgcccgcucugcgaucgaagaucuucucuucgacaaggucaccaucgccgauccuggcuacaugcagggguacgacgauugcaugcagcaaggacccgcuuccgcccgggaccugauuugugcucaguauguggccggcuacaaaguucugccuccccucauggaugugaacauggaggccgcuuauaccagcucccugcuugggucuaucgcgggagucggcuggacagccgggcugagcuccuuugcugccauuccguucgcccagagcaucuuuuacagacucaauggcgugggaauuacccaacagguucugucugaaaaccagaagcugaucgcuaauaaauucaaccaggcccuuggcgcgaugcaaacaggguuuacgaccacaaaugaggcuuuccggaaggugcaggacgccgucaacaacaaugcccaggcucucuccaagcuggccagcgaacugucuaacaccuucggagcgaucagcgcuuccauuggcgauaucauucagcgccucgacgugcuggagcaagaugcccagaucgacagacuuauuaaugggcggcugacaacccucaacgccuuuguugcucagcagcuggugagaucugagagcgccgcucuguccgcccaacuugcgaaagauaaggucaaugaaugcgugaaagcccagucuaagcgcagcggauucuguggccagggcacgcacaucguguccuuugucguuaacgcuccuaaugggcuguauuucaugcaugugggauacuaucccagcaaccacaucgagguggucucugccuacggccucugcgacgcugccaauccuaccaacuguauugcccccgugaauggguacuuuaucaaaacaaacaauacccggauuguugacgaaugguccuauacaggaagcuccuucuacucuccggagccuaucaccagccugaacacaaaguauguggcuccccaggucaccuaccaaaauauuuccacgaaccucccuccuccccugcuuggcaacucuacagggaucgauuuucaggacgagcuggaugaguucuuuaagaaugugagcaccuccauucccaacuucggaagccucacccagaucaauacaacccugcuggaccuuacguaugaaaugcugucucuccaacagguugugaaagcgcugaacgaauccuacaucgaucucaaggagcugggcaauuauacauacuacaacaaauggccgugguauauuuggcuuggcuuuaucgccgggcuggucgcucucgcccugugcguguucuuuauucuguguugcaccggauguggcacaaauugcauggggaaacuuaagugcaacagauguugcgaccgcuacgaagaguaugaucuggagccccauaagguccacgugcacuga

SEQ ID NO: 936 - RNA, 4062 nt, Artificial Sequence
  derived and/or modified CDS sequence (opt5) from MERS-CoV__AIZ74450__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaagacccaugccacgcuuuuuggcagcguggcuugugaacacauuuccagcacaaugucucaguacucccggagcaccagaucuaugcucaaacgccgggacuccacauaugggccccugcagaccccuguuggcugcgugcugggacucgucaauagcucucuguucguggaggauuguaaacuuccccugggccaaucccucugcgcccugccggacaccccuagcacacugacgcccagauccguucgcagcgugcccggggaaaugcggcuugcgucuaucgccuuuaaccacccuauucaggucgaucagcucaauagcuccuacuucaagcugucuaucccgaccaacuuuagcuucggagugacacaagaguauauccagaccacaauucagaaggugaccgucgacuguaaacaguacguuugcaauggcuuccaaaagugcgaacagcugcucagagaguaugggcaguuuuguuccaagaucaaccaggcucugcauggagccaaucuucgccaagaugacucugugcggaaccuguucgcuagcgugaaauccucucagagcucccccauuaucccuggcuuugggggcgacuucaaucucacgcugcuggagcccgucagcauuucuacaggauccagaagcgcccgcucugcgaucgaagaucuucucuuugacaaggugaccaucgccgauccuggcuacaugcagggguacgacgauugcaugcaccagggacccgcuuccgcccgggaccugauuugugcucaauauguugccggcuacaaagugcugccuccccucauggaugucaacauggaggccgcuuauaccagcucccugcuugggucuaucgcgggagugggcuggacagccgggcugagcuccuucgcugccauuccguuugcccagagcaucuucuacagacucaauggcguuggaauuacccagcaagugcugucugaaaaccagaagcugaucgcuaauaaauuuaaccaggcccuuggcgcgaugcagacaggguucacgaccacaaaugaggcuuuucggaagguccaagacgccgugaacaacaaugcccaggcucucuccaagcuggccagcgaacugucuaacaccuucggagcgaucagcgcuuccauuggcgauaucauucagcgccucgacguucuggagcaggaugcccaaaucgacagacuuauuaaugggcggcugacaacccucaacgccuucguggcucagcagcuggucagaucugagagcgccgcucuguccgcccagcuugcgaaagauaaggugaaugaaugcgugaaagcccaaucuaagcgcagcggauuuuguggccagggcacgcauaucgucuccuucguugugaacgcuccuaaugggcuguauuuuaugcacgugggauacuaucccagcaaccauaucgaggucgugucugccuacggccucugcgacgcugccaauccuaccaacuguauugcccccguuaauggguacuucaucaaaacaaacaauacccggauuguggacgaaugguccuauacaggaagcuccuuuuacucuccggagccuaucaccagccugaacacaaaguaugucgcuccccaggugaccuaccagaauauuuccacgaaccucccuccuccccugcuuggcaacucuacagggaucgauuuccaagacgagcuggaugaauuuuucaagaauguuagcaccuccauucccaacuuuggaagccucacccagaucaauacaacccugcuggaccuuacguaugagaugcugucucuccagcaaguggucaaagcgcugaacgaauccuacaucgaucucaaggagcugggcaauuauacauacuacaacaaauggccgugguauauuuggcuuggcuucaucgccgggcugguggcucucgcccugugcgucuuuuucauucuguguugcaccggauguggcacaaauugcauggggaaacuuaagugcaacagauguugcgaccgcuacgaagaguaugaucuggagccccacaaggugcacguucauuga

SEQ ID NO: 937 - RNA, 4062 nt, Artificial Sequence
  derived and/or modified CDS sequence (opt5) from MERS-CoV__AJD81440__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuaaccccagcacauccgcuaccaucagaaaaauuuacccugccuucaugcuggggagcucugugggaaauuuuuccgauggcaagauggggcgguucuuuaaccauacacuuguccugcucccggacggauguggcacccugcugcgcgcguucuacugcauccucgagcccagaagcgggaaucacuguccugccggaaacucuuauacguccuuugcuacauaccauacccccgccacagauugcagcgacggcaauuauaaccggaaugcuucucugaacuccuucaaggaauacuucaaucuucgcaacuguaccuuuauguauaccuacaauauuacagaggaugaaauccuggagugguucggcaucacgcagaccgcccaaggggugcaccucuuuagcuccagauauguggaccuguacggaggcaacauguuccaguuugcgacacuuccugucuacgacaccauuaaauauuacucuaucauuccccacagcauccgguccauucagagcgaucgcaaggccugggcugccuucuauguuuacaaacugcagccgcucacauuucugcuggacuucucuguggauggguauaucagacgggcuaucgacugcggauuuaacgaucucucccaacugcauuguagcuacgagucuuucgacguggaaagcggcgucuauuccgugucuagcuuugaggccaagccuuccgggagcguuguggaacaggccgagggagucgagugcgauuucucuccccuucuguccggcaccccuccccagguguacaauuuuaaacgccucguuuucacgaacuguaauuacaaccugacaaaacuucugagccucuucucugugaaugacuuuaccugcucccaaauuagccccgcugcgaucgccuccaacuguuauucuagccugauucuggauuacuucuccuauccucucucuaugaaaagcgaccuguccgucagcucugcuggcccgaucucccaguuuaauuacaagcagagcuucucuaacccuaccugccuuauucuggccacagugccccacaaucucaccacaaucacgaagccccugaaguauuccuacaucaacaagugcagcagacuucugucugaugaccggaccgaagucccucagcucgugaaugccaaccaauauagccccuguguuuccauugugccgagcacagucugggaggacggggauuacuaccgcaaacagcugucuccucuggaaggaggcggguggcucguggcuuccggaagcaccguugccaugacagagcagcugcagaugggcuuugggaucaccgugcaauauggcacggacaccaauuccgucugccccaaacuugaguucgcgaacgauacaaagauugcuucucagcugggaaauuguguggaauacagccucuauggcguguccgggagaggaguuuuucagaacugcaccgccgucggcgugcggcagcaaagauucguguacgacgccuaucagaaccuggucggguacuauucugaugacggaaauuacuacugucugcgcgcuugcgugagcguuccuguguccgucaucuaugauaaggagacaaagacccaugccacgcuuuuuggcucuguggcuugugaacacauuagcuccacaaugagccaguacucucgguccaccagaagcaugcucaaacgccgggacucuacauaugggccccugcagaccccuguuggcugcgugcugggacucgucaacuccagccuguucguggaggauuguaaacuuccccugggccaaucucucugcgcccugccggacaccccuuccacacugacgcccagaagcguucgcuccgugcccggggaaaugcggcuugcgagcaucgccuuuaaucacccuauucaggucgaucagcucaacucuagcuacuucaagcuguccaucccgaccaauuuuucuuucggagugacacaagaguauauccagaccacaauucagaaggugaccgucgacuguaaacaguacguuugcaacggcuuccaaaagugcgaacagcugcucagagaguaugggcaguuuuguagcaagaucaaucaggcucugcauggagccaaccuucgccaagaugacuccgugcggaaucuguucgcuucugugaaaagcucccagucuagccccauuaucccuggcuuugggggcgacuucaaccucacgcugcuggagcccgucuccauuagcacaggaucuagauccgcccgcagcgcgaucgaagaucuucucuuugacaaggugaccaucgccgauccuggcuacaugcagggguacgacgauugcaugcagcaaggacccgcuucugcccgggaccugauuugugcucaguauguugccggcuacaaagugcugccuccccucauggaugucaauauggaggccgcuuauaccuccagccugcuuggguccaucgcgggagugggcuggacagccgggcugucuagcuucgcugccauuccguuugcccaguccaucuucuacagacucaacggcguuggaauuacccaacaggugcugagcgaaaaucagaagcugaucgcuaacaaauuuaaucaggcccuuggcgcgaugcaaacaggguucacgaccacaaacgaggcuuuucggaagguccaggacgccgugaacaauaacgcccaggcucucucuaagcuggccuccgaacugagcaauaccuucggagcgaucucugcuagcauuggcgauaucauucagcgccucgacguucuggagcaagaugcccagaucgacagacuuauuaacgggcggcugacaacccucaaugccuucguggcucagcagcuggucagauccgagucugccgcucugagcgcccaacuugcgaaagauaaggugaacgaaugcgugaaagcccaguccaagcgcucuggauuuuguggccagggcacgcacaucgucagcuucguugugaaugcuccuaacgggcuguauuuuaugcaugugggauacuaucccuccaaucacaucgaggucgugagcgccuacggccucugcgacgcugccaacccuaccaauuguauugcccccguuaacggguacuucaucaaaacaaauaacacccggauuguggacgaauggucuuauacaggauccagcuuuuacgcuccggagccuaucaccucccugaauacaaaguaugucgcgccccaggugaccuaccaaaacauuucuacgaaccucccuccuccccugcuuggcaauagcacagggaucgauuuccaggacgagcuggaugaauuuuucaagaacguuuccaccucuauucccaauuuuggaagccucacccagaucaacacaacccugcuggaccuuacguaugagaugcugucccuccaacagguggucaaagcccugaaugaaagcuacaucgaucucaaggagcugggcaacuauacauacuacaauaaauggccgugguauauuuggcuuggcuucaucgcugggcugguggcccucgcccugugcgucuuuuucauucuguguugcaccggauguggcacaaacugcauggggaaacuuaagugcaauagauguugcgaccgcuacgaagaguaugaucuggagccccauaaggugcacguucacuga

SEQ ID NO: 938 - RNA, 4062 nt, Artificial Sequence
  derived and/or modified CDS sequence (opt5) from MERS-CoV__AKI29284__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaauuugcgaaugauacaaagauugcuagccagcugggaaacuguguggaguacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaagacccaugccacgcuuuuuggcagcguggcuugugaacacauuuccagcacaaugucucaguacucccggagcaccagaucuaugcucaaacgccgggacuccacauaugggccccugcagaccccuguuggcugcgugcugggacucgucaauagcucucuguucguggaggauuguaaacuuccccugggccaaucccucugcgcccugccggacaccccuagcacacugacgcccagauccguucgcagcgugcccggggaaaugcggcuugcgucuaucgccuuuaaccacccuauucaggucgaucagcucaauagcuccuacuucaagcugucuaucccgaccaacuuuagcuucggagugacacaagaguauauccagaccacaauucagaaggugaccgucgacuguaaacaguacguuugcaauggcuuccaaaagugcgaacagcugcucagagaguaugggcaguuuuguuccaagaucaaccaggcucugcauggagccaaucuucgccaagaugacucugugcggaaccuguucgcuagcgugaaauccucucagagcucccccauuaucccuggcuuugggggcgacuucaaucucacgcugcuggagcccgucagcauuucuacaggauccagaagcgcccgcucugcgaucgaagaucuucucuuugacaaggugaccaucgccgauccuggcuacaugcagggguacgacgauugcaugcagcaaggacccgcuuccgcccgggaccugauuugugcucaguauguugccggcuacaaagugcugccuccccucauggaugucaacauggaggccgcuuauaccagcucccugcuugggucuaucgcgggagugggcuggacagccgggcugagcuccuucgcugccauuccguuugcccagagcaucuucuacagacucaauggcguuggaauuacccaacaggugcugucugaaaaccagaagcugaucgcuaauaaauuuaaccaggcccuuggcgcgaugcaaacaggguucacgaccacaaaugaggcuuuucggaagguccaggacgccgugaacaacaaugcccaggcucucuccaagcuggccagcgaacugucuaacaccuucggagcgaucagcgcuuccauuggcgauaucauucagcgccucgacguucuggagcaagaugcccagaucgacagacuuauuaaugggcggcugacaacccucaacgccuucguggcucagcagcuggucagaucugagagcgccgcucuguccgcccaacuugcgaaagauaaggugaaugaaugcgugaaagcccagucuaagcgcagcggauuuuguggccagggcacgcacaucgucuccuucguugugaacgcuccuaaugggcuguauuuuaugcaugugggauacuaucccagcaaccacaucgaggucgugucugccuacggccucugcgacgcugccaauccuaccaacuguauugcccccguuaauggguacuucaucaaaacaaacaauacccggauuguggacgaaugguccuauacaggaagcuccuuuuacgcuccggagccuaucaccucucugaacacaaaguaugucgcgccccaggugaccuaccaaaauauuagcacgaaccucccuccuccccugcuuggcaacuccacagggaucgauuuccaggacgagcuggaugaauuuuucaagaauguuucuaccagcauucccaacuuuggaucccucacccagaucaauacaacccugcuggaccuuacguaugagaugcugagccuccaacagguggucaaagcccugaacgaaucuuacaucgaucucaaggagcugggcaauuauacauacuacaacaaauggccgugguauauuuggcuuggcuucaucgcugggcugguggcccucgcccugugcgcuuucuucauucuguguugcaccggauguggcacaaauugcauggggaaacuuaagugcaacagauguugcgaccgcuacgaagaguaugaucuggagccccauaagguccacgugcacuga

SEQ ID NO: 939 - RNA, 4062 nt, Artificial Sequence
  derived and/or modified CDS sequence (opt5) from MERS-CoV__AKL59401__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagagcuaccauccggaaaauuuacccugccuucaugcuggggagcucugugggaaacuuuuccgauggcaagauggggcgcuucuuuaaucauacacuuguccugcucccggacggauguggcacccugcugagagcguucuacugcauccucgagccccggagcgggaaccacuguccugccggaaauucuuauacguccuuugcuacauaccauacccccgccacagauugcagcgacggcaacuauaaucgcaacgcuucucuuaauuccuucaaggaauacuucaaccuuagaaauuguaccuuuauguauaccuacaacauuacagaggaugaaauccuggagugguucggcaucacgcagaccgcccaaggggugcaccucuuuagcucccgguauguggaccuguacggaggcaauauguuccaguuugcgacacuuccugucuacgacaccauuaaauauuacucuaucauuccccacagcauccgcuccauucagagcgauagaaaggccugggcugccuucuauguuuacaaacugcagccgcucacauuucugcuggacuucucuguggauggguauauccggcgcgcuaucgacugcggauuuaacgaucucucccaacugcauuguagcuacgagucuuucgacguggaaagcggcgucuauuccgugucuagcuuugaggccaagccuuccgggagcguuguggaacaggccgagggagucgagugcgauuucucuccccuucuguccggcaccccuccccagguguacaacuuuaaaagacucguuuucacgaauuguaacuacaaucugacaaagcugcugagccucuucucugugaacgacuuuaccugcucccaaauuagccccgcugcgaucgccuccaauuguuauucuagccugauucuggauuacuucuccuauccucucucuaugaaaagcgaccuguccgucagcucugcuggcccgaucucccaguuuaacuacaagcagagcuucucuaauccuaccugccuuauucuggccacagugccccacaaccucaccacaaucacgaagccccugaaauauuccuacaucaauaagugcagccggcuucugucugaugaccgcaccgaagucccucagcucgugaacgccaaucaauauagccccuguguuuccauucugccgagcacagugugggaggacggggauuacuacagaaaacagcugucuccucucgaaggaggcggguggcuggucgcuuccggaagcaccguggccaugacagagcagcuucagaugggcuuugggaucaccguucaauauggcacggacaccaacuccgugugccccaagcuggaguucgcgaaugauacaaaaauugcuucucagcucggaaacugugucgaauacagccuguauggcguguccgggcggggaguguuucagaauugcaccgccguuggcgucagacagcaacgcuucguguacgacgccuaucagaaccuggugggguacuauucugaugacggaaacuacuacugucuucgggcuugcgucagcgugccuguuuccgugaucuaugauaaggagacaaagacccaugccacgcucuuuggcucugucgcuugugaacacauuagcuccacaaugagccaguacucuagauccacccgcagcaugcugaaacggagagacucuacauaugggccccugcagaccccugugggcugcguucucggacuggucaauuccagccuuuucguggaggauuguaagcugccccucggccaaucucugugcgcccugccggacaccccuuccacacuuacgccccgcagcgugcgguccguucccggggaaaugagacucgcgagcaucgccuuuaaccacccuauucagguggaucagcuuaauucuagcuacuucaaacuguccaucccgaccaacuuuucuuucggagucacacaagaguauauccagaccacaauucagaaggugaccguggacuguaaacaguacgucugcaauggcuuccaaaagugcgaacagcuccugcgcgaguaugggcaguuuuguagcaagaucaaccaggcccuucauggagcuaaucugcggcaagaugacuccguuagaaaccucuucgcuucugugaaaagcucccagucuagccccauuaucccuggcuuugggggcgacuucaaucugacgcugcuugagcccguguccauuagcacaggaucucgcuccgcccggagcgcgaucgaagaucuccuguuugacaaggucaccaucgccgauccuggcuacaugcagggguacgacgauugcaugcagcaaggacccgcuucugccagagaccugauuugugcucaguauguggccggcuacaaaguucucccuccccugauggaugugaacauggaggccgcuuauaccuccagccuucugggguccaucgcgggagucggcuggacagccgggcucucuagcuucgcugccauuccguuugcccaguccaucuucuaccggcugaauggcgugggaauuacccaacagguucugagcgaaaaccagaagcugaucgcuaauaaauuuaaccaggcccucggcgcgaugcaaacaggguucacgaccacaaaugaggcuuuucgcaaggugcaggacgccgucaacaacaaugcccaggcucugucuaagcuggccuccgaacucagcaacaccuucggagcgaucucugcuagcauuggcgauaucauucagagacuggacgugcuugagcaagaugcccagaucgaccggcugauuaaugggagacucacaacccugaacgccuucguugcucagcagcuggugcgcuccgagucugccgcucuuagcgcccaacuggcgaaagauaaggucaaugaaugcgugaaagcccaguccaagcggucuggauuuuguggccagggcacgcacaucgugagcuucgucguuaacgcuccuaaugggcucuauuuuaugcaugugggauacuaucccuccaaccacaucgagguggucagcgccuacggccugugcgacgcugccaauccuaccaacuguauugcccccgugaauggguacuucaucaaaacaaacaauaccagaauuguugacgaauggucuuauacaggauccagcuuuuacgcuccggagccuaucaccucccucaacacaaaguauguggcgccccaggucaccuaccaaaauauuucuacgaaccugccuccuccccuucugggcaacagcacagggaucgauuuccaggacgagcucgaugaauuuuucaagaauguguccaccucuauucccaacuuuggaagccugacccagaucaauacaacccugcuugaccugacguaugagaugcucucccugcaacagguugugaaagcccucaacgaaagcuacaucgaucugaaggagcuuggcaauuauacauacuacaacaaauggccgugguauauuuggcugggcuucaucgcugggcucgucgcccuggcccugugcguguuuuucauucuuuguugcaccggauguggcacaaauugcauggggaagcugaaaugcaaccgcuguugcgacagauacgaagaguaugaucucgagccccauaagguccacgugcacuga

SEQ ID NO: 940 - RNA, 4062 nt, Artificial Sequence
  derived and/or modified CDS sequence (opt5) from MERS-CoV__AKM76229__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaagcuccugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaaacagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaagacccaugccacgcuuuuuggcagcguggcuugugaacacauuuccagcacaaugucucaguacucccggagcaccagaucuaugcucaaacgccgggacuccacauaugggccccugcagaccccuguuggcugcgugcugggacucgucaauagcucucuguucguggaggauuguaaacuuccccugggccaaucccucugcgcccugccggacaccccuagcccccugacacccagauccguucgcagcgugccuggggaaaugcggcuugcgucuaucgccuuuaaccacccgauucaggucgaucagcucaauagcuccuacuucaagcugucuauccccacgaacuuuagcuucggagugacccaagaguauauccagacaaccauucagaaggugacagucgacuguaaacaguacaucugcaauggcuuccaaaagugcgaacagcugcucagagaguaugggcaguuuuguuccaagauuaaccaggcucugcauggagccaaucuucgccaagaugacucuguucggaaccuguucgcuagcgugaaauccucucagagcuccccuaucauucccggcuuugggggcgacuucaaucucacccugcuggagccugugagcaucucuacgggauccagaagcgcccgcucugcgaucgaagaucuucucuuugacaaggucacaauugccgaucccggcuacaugcagggguacgacgauugcaugcagcaaggaccugcuuccgcccgggaccugaucugugcucaguauguggccggcuacaaaguucugcccccgcucauggaugugaacauggaggccgcuuauaccagcucccugcuugggucuauugcgggagucggcuggaccgccgggcugagcuccuucgcugccaucccuuuugcccagagcauuuucuacagacucaauggcgugggaaucacacaacagguucugucugaaaaccagaagcugaucgcuaauaaauuuaaccaggcccuuggcgcgaugcaaaccggguucacaacgaccaaugaggcuuuucggaaggugcaggacgccgucaacaacaaugcccaggcucucuccaagcuggccagcgaacugucuaacacauucggagcgauuagcgcuuccaucggcgauauuauccagcgccucgacgugcuggagcaagaugcccagauugacagacuuaucaaugggcggcugaccacacucaacgccuucguugcucagcagcuggugagaucugagagcgccgcucuguccgcccaacuugcgaaagauaaggucaaugaaugcgugaaagcccagucuaagcgcagcggauuuuguggccagggcacccacaucguguccuucgucguuaacgcucccaaugggcuguauuuuaugcaugugggauacuauccuagcaaccacauugagguggucucugccuacggccucugcgacgcugccaaucccacgaacuguaucgccccggugaauggguacuucauuaaaaccaacaauacacggaucguugacgaaugguccuauaccggaagcuccuuuuacucuccugagcccauuacaagccugaacaccaaguauguggcuccucaggucacauaccaaaauaucuccaccaaccuucccccuccccugcuuggcaacucuacggggauugauuuccaggacgagcuggaugaauuuuucaagaaugugagcacauccaucccgaacuuuggaagccucacccagaucaauaccacacugcuggaccuuaccuaugagaugcugucucuccaacagguugugaaagcgcugaacgaauccuacauugaucucaaggagcugggcaauuauacguacuacaacaaauggcccugguauaucuggcuuggcuucauugccgggcuggucgcucucgcccugugcguguuuuucauccuguguugcacaggauguggcaccaauugcauggggaaacuuaagugcaacagauguugcgaccgcuacgaagaguaugaucuggagccucauaagguccacgugcacuga

SEQ ID NO: 941 - RNA, 4062 nt, Artificial Sequence
  derived and/or modified CDS sequence (opt5) from MERS-CoV__AKM76239__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaacucccucagcuggucaacgccaaucaauauucccccugugugagcauuguuccgucuacagugugggaggacggggauuacuaccgcaaacagcuguccccucucgaaggaggcggguggcuggucgcuagcggauccaccguggccaugacagagcagcuucagaugggcuuugggaucaccguucaauauggcacggacaccaacucugugugccccaagcuggaguucgcgaaugauacaaaaauugcuagccagcucggaaacugugucgaauacucccuguauggcgugucugggagaggaguguuucagaauugcaccgccguuggcguccggcagcaaagauucguguacgacgccuaucagaaccuggugggguacuauagcgaugacggaaacuacuacugucuucgcgcuugcgucuccgugccuguuucugugaucuaugauaaggagacaaagacccaugccacgcucuuuggcagcgucgcuugugaacacauuuccagcacaaugucucaguacucccggagcaccagaucuaugcugaaacgccgggacuccacauaugggccccugcagaccccugugggcugcguucucggacuggugaauagcucucuuuucgucgaggauuguaagcugccccucggccaaucccugugcgcccugccggacaccccuagcacacuuacgcccagauccgugcgcagcguucccggggaaaugcggcucgcgucuaucgccuuuaaccacccuauucagguggaucagcugaauagcuccuacuucaaacugucuaucccgaccaacuuuagcuucggagucacacaagaguauauccagaccacaauucagaaggugaccguggacuguaaacaguacaucugcaauggcuuccaaaagugcgaacagcuccugagagaguaugggcaguuuuguuccaagauuaaccaggcccuucauggagccaaucugcgccaagaugacucuguccggaaccucuucgcuagcguuaaauccucucagagcucccccaucauuccuggcuuugggggcgacuucaaucugacgcugcuugagcccgugagcaucucuacaggauccagaagcgcccgcucugcgaucgaagaucuccuguuugacaaggugaccauugccgauccuggcuacaugcagggguacgacgauugcaugcagcaaggacccgcuuccgcccgggaccugaucugugcucaguaugucgccggcuacaaagugcucccuccccugauggauguuaacauggaggccgcuuauaccagcucccuucuggggucuauugcgggagugggcuggacagccgggcucagcuccuucgcugccaucccguuugcccagagcauuuucuacagacugaauggcgucggaaucacccaacaggugcugucugaaaaccagaaacuuaucgcuaauaaguuuaaccaggcccucggcgcgaugcaaacaggguucacgaccacaaaugaggcuuuucggaagguucaggacgccgugaacaacaaugcccaggcucuguccaagcuggccagcgaacucucuaacaccuucggagcgauuagcgcuuccaucggcgauauuauccagcgccuggacguccuugagcaagaugcccagauugacagacugaucaaugggcggcucacaacccugaacgccuucguggcucagcagcugguuagaucugagagcgccgcucuuuccgcccaacuggcgaaagauaaggugaaugaaugcgucaaagcccagucuaagcgcagcggauuuuguggccagggcacgcacaucguguccuucguggucaacgcuccuaaugggcucuauuuuaugcauguuggauacuaucccagcaaccacauugagguggugucugccuacggccugugcgacgucgcuaauccuaccaacuguaucgcccccgugaauggguacuucauuaaaacaaacaauacccggaucguugacgaaugguccuauacaggaagcuccuuuuacucuccggagccuauuaccagccucaacacaaaguauguggcuccccaggucaccuaccaaaauaucuccacgaaccugccuccuccccuucugggcaacucuacagggauugauuuccaggacgagcucgaugaauuuuucaagaauuuuagcaccuccauccccaacuucggaagccugacccagaucaauacaacccugcuugaccugacguaugagaugcucucucugcaacaggugguuaaagcucucaacgaauccuacauugaucugaaggagcuuggcaauuauacauacuacaacaaauggccgugguauaucuggcugggcuuuauugcggggcucguggcccuggcucugugcgucuucuuuauccuuuguugcaccggauguggcacaaauugcauggggaagcugaaaugcaacagauguugcgaccgcuacgaagaguaugaucucgagccccauaaggugcacguccacuga

SEQ ID NO: 942 - RNA, 4062 nt, Artificial Sequence
  derived and/or modified CDS sequence (opt5) from MERS-CoV__AKN11072__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcacagugccgucuaccgucugggaggacggggauuacuaccgcaaacagcuguccccucuggaaggaggcggguggcucguggcuagcggauccacaguugccaugaccgagcagcugcagaugggcuuugggauuacggugcaauauggcaccgacacaaacucugucugccccaaacuugaguucgcgaaugauaccaagaucgcuagccagcugggaaacuguguggaauacucccucuauggcgugucugggagaggaguuuuucagaauugcacagccgucggcgugcggcagcaaagauucguguacgacgccuaucagaaccuggucggguacuauagcgaugacggaaacuacuacugucugcgcgcuugcguguccguuccugugucugucauuuaugauaaggagaccaagacgcaugccacacuuuuuggcagcguggcuugugaacacaucuccagcaccaugucucaguacucccggagcacaagaucuaugcucaaacgccgggacuccaccuaugggccccugcagaccccuguuggcugcgugcugggacucgucaauagcucucuguucguggaggauuguaaacuuccccugggccaaucccucugcgcccugccggacacaccuagcacgcugacccccagauccguucgcagcgugcccggggaaaugcggcuugcgucuauugccuuuaaccacccuauccaggucgaucagcucaauagcuccuacuucaagcugucuauuccgacaaacuuuagcuucggagugacccaagaguauauccagacaaccauccagaaggugacggucgacuguaaacaguacguuugcaauggcuuccaaaagugcgaacagcugcucagagaguaugggcaguuuuguuccaagauuaaccaggcucugcauggagccaaucuucgccaagaugacucugugcggaaccuguucgcuagcgugaaauccucucagagcucccccaucauuccuggcuuugggggcgacuucaaucucacacugcuggagcccgucagcaucucuaccggauccagaagcgcccgcucugcgauugaagaucuucucuuugacaaggugaccaucgccgauccuggcuacaugcagggguacgacgauugcaugcagcaaggacccgcuuccgcccgggaccugaucugugcucaguauguugccggcuacaaagugcugccuccccucauggaugucaacauggaggccgcuuauacaagcucccugcuugggucuauugcgggagugggcuggaccgccgggcugagcuccuucgcugccaucccguuugcccagagcauuuucuacagacucaauggcguuggaaucacacaacaggugcugucugaaaaccagaagcugauugcuaauaaauuuaaccaggcccuuggcgcgaugcaaacgggguucaccacaaccaaugaggcuuuucggaagguccaggacgccgugaacaacaaugcccaggcucucuccaagcuggccagcgaacugucuaacacauucggagcgaucagcgcuuccaucggcgauauuauccagcgccucgacguucuggagcaagaugcccagauugacagacuuaucaaugggcggcugaccacgcucaacgccuucguggcucagcagcuggucagaucugagagcgccgcucuguccgcccaacuugcgaaagauaaggugaaugaaugcgugaaagcccagucuaagcgcagcggauuuuguggccagggcacccacauugucuccuucguugugaacgcuccuaaugggcuguauuuuaugcaugugggauacuaucccagcaaccacaucgaggucgugucugccuacggccucugcgacgcugccaauccuacaaacuguaucgcccccguuaauggguacuucauuaaaaccaacaauacacggaucguggacgaaugguccuauaccggaagcuccuuuuacgcuccggagccuauuacaucucugaacaccaaguaugucgcgccccaggugacguaccaaaauaucagcacaaaccucccuccuccccugcuuggcaacuccaccgggauugauuuccaggacgagcuggaugaauuuuucaagaauguuucuaccagcauccccaacuuuggaucccucacacagauuaauaccacgcugcuggaccuuacauaugagaugcugagccuccaacagguggucaaagcccugaacgaaucuuacaucgaucucaaggagcugggcaauuauaccuacuacaacaaauggccgugguauaucuggcuuggcuucauugcugggcugguggcccucgcccugugcgucuuuuucauccuguguugcacaggauguggcaccaauugcauggggaaacuuaagugcaacagauguugcgaccgcuacgaagaguaugaucuggagccccauaaggugcacguucacuga

(The sequence listing continues in the following parts.)

The invention claimed is:

1. A method of treatment or prophylaxis of Middle East respiratory syndrome (MERS) coronavirus infections comprising the steps:

a) providing a composition comprising a mRNA comprising at least one coding region, encoding an antigenic protein comprising a spike protein (S) of a Middle East respiratory (MERS) coronavirus, said coding sequence being at least 90% identical to a nucleic acid sequence selected from the group consisting of SEQ ID NOs: 2373, 2374, 2375, 2376, 2377 and 2378, wherein the mRNA is associated with lipid nanoparticles (LNPs); and b) administering an effective amount of the composition to an organism, thereby stimulating a humoral immune response to the antigenic protein in the organism.

2. The method of claim 1, wherein the mRNA is associated with LNPs comprising: (i) a cationic lipid, (ii) a PEG-modified lipid, (iii) a non-cationic lipid and (iv) a sterol.

3. The method according to claim 1, wherein the mRNA is administered to the organism by subcutaneous, intramuscular or intradermal injection.

4. The method according to claim 3, wherein the injection is carried out by using conventional needle injection or jet injection.

5. The method of claim 1, wherein the mRNA is associated with LNPs comprising: (i) a cationic lipid, (ii) an aggregation reducing agent, (iii) optionally, a non-cationic lipid and (iv) optionally, a sterol.

6. The method of claim 5, wherein the aggregation reducing agent comprises a PEG-modified lipid.

7. The method of claim 6, wherein the mRNA is associated with LNPs comprising: (i) the cationic lipid, (ii) the PEG-modified lipid, (iii) the non-cationic lipid and (iv) the sterol.

8. The method of claim 1, wherein said coding region encodes a stabilized spike protein (S_stabilized) of a MERS coronavirus having the amino acid residue at position 1060 changed to Proline and the amino acid residue at position 1061 changed to Proline, said coding region being at least 90% identical to a nucleic acid sequence selected from the group consisting of SEQ ID NOs: 2373, 2374, 2375, 2376, 2377 and 2378.

9. The method of claim 1, wherein the mRNA comprises at least one histone stem-loop.

10. The method of claim 1, wherein the mRNA comprises, in 5' to 3' direction, the following elements:
 a) a 5'-cap structure,
 b) said at least one coding region,
 c) a poly(A) tail,
 d) optionally a poly(C) tail, and
 e) optionally a histone stem-loop.

* * * * *